United States Patent 11,446,398 (REGULATED BIOCIRCUIT SYSTEMS) - sequence listing, part 12

SEQ ID NO: 50659 - protein, 69 aa, Homo sapiens
  Payload ID: 10122
  Gene Symbol: MT1M
  Gene Name: metallothionein 1M
  ENSP ID: ENSP00000457575
MDPNCSCTTGVSCACTGSCTCKECKCTSCKKSECGAISRNLGLWLRLGGNPRLALSASFWGTGLSLPSL

SEQ ID NO: 50660 - protein, 61 aa, Homo sapiens
  Payload ID: 10123
  Gene Symbol: MT1X
  Gene Name: metallothionein 1X
  Uniprot ID: P80297
  ENSP ID: ENSP00000377995
MDPNCSCSPVGSCACAGSCKCKECKCTSCKKSCCSCCPVGCAKCAQGCICKGTSDKCSCCA

SEQ ID NO: 50661 - protein, 46 aa, Homo sapiens
  Payload ID: 10123
  Gene Symbol: MT1X
  Gene Name: metallothionein 1X
  ENSP ID: ENSP00000475537
MDPNCSCSPVGSCACAGSCKCKECKCTSCKKSECRAFPANLGDGPS

SEQ ID NO: 50662 - protein, 46 aa, Homo sapiens; identical to SEQ ID NO: 50661
  Payload ID: 10123
  Gene Symbol: MT1X
  Gene Name: metallothionein 1X
  ENSP ID: ENSP00000475791

SEQ ID NO: 50663 - protein, 61 aa, Homo sapiens
  Payload ID: 10124
  Gene Symbol: MT2A
  Gene Name: metallothionein 2A
  Uniprot ID: P02795
  ENSP ID: ENSP00000245185
MDPNCSCAAGDSCTCAGSCKCKECKCTSCKKSCCSCCPVGCAKCAQGCICKGASDKCSCCA

SEQ ID NO: 50664 - protein, 73 aa, Homo sapiens
  Payload ID: 10124
  Gene Symbol: MT2A
  Gene Name: metallothionein 2A
  ENSP ID: ENSP00000456804
MDPNCSCAAGDSCTCAGSCKCKECKCTSCKKSKWDPLFPLPLPCPPACPLSTILRGIKAVWGCPIARKLLPPQ

SEQ ID NO: 50665 - protein, 68 aa, Homo sapiens
  Payload ID: 10125
  Gene Symbol: MT3
  Gene Name: metallothionein 3
  Uniprot ID: P25713
  ENSP ID: ENSP00000200691
MDPETCPCPSGGSCTCADSCKCEGCKCTSCKKSCCSCCPAECEKCAKDCVCKGGEAAEAEAEKCSCCQ

SEQ ID NO: 50666 - protein, 113 aa, Homo sapiens
  Payload ID: 10125
  Gene Symbol: MT3
  Gene Name: metallothionein 3
  ENSP ID: ENSP00000455353
MKGKRGREELGNTQSAFFSTFGDAKPRVQLLGEARSPPPAAALLDMDPETCPCPSGGSCTCADSCKCEGCKCTSCKKSCCSCCPAECEKCAKDCVCKGGEAAEAEAEKCSCCQ

SEQ ID NO: 50667 - protein, 81 aa, Homo sapiens
  Payload ID: 10125
  Gene Symbol: MT3
  Gene Name: metallothionein 3
  ENSP ID: ENSP00000455980
MKGKRGREELGNTQSAFFSTFGDGGSCTCADSCKCEGCKCTSCKKSCCSCCPAECEKCAKDCVCKGGEAAEAEAEKCSCCQ

SEQ ID NO: 50668 - protein, 92 aa, Homo sapiens
  Payload ID: 10125
  Gene Symbol: MT3
  Gene Name: metallothionein 3
  ENSP ID: ENSP00000457164
MDPETCPCPSGGSCTCADSCKCEGCKCTSCKKSECGDPSPLPPPPLLCGVGVSPRRMWRDSQAPIPWFLTLAGIEPPGQTLKYRCPCPTPRN

SEQ ID NO: 50669 - protein, 62 aa, Homo sapiens
  Payload ID: 10126
  Gene Symbol: MT4
  Gene Name: metallothionein 4
  Uniprot ID: P47944
  ENSP ID: ENSP00000219162
MDPRECVCMSGGICMCGDNCKCTTCNCKTYWKSCCPCCPPGCAKCARGCICKGGSDKCSCCP

SEQ ID NO: 50670 - protein, 508 aa, Homo sapiens
  Payload ID: 10127
  Gene Symbol: MTL5
  Gene Name: metallothionein-like 5, testis-specific (tesmin)
  Uniprot ID: Q9Y4I5
  ENSP ID: ENSP00000255087
MEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMVICQLKGGTQMLCIDNSRTRELKALHLVPQYQDQNNYLQSDVPKPMTALVGRFLPASTKLNLITQQLEGALPSVVNGSAFPSGSTLPGPPKITLAGYCDCFASGDFCNNCNCNNCCNNLHHDIERFKAIKACLGRNPEAFQPKIGKGQLGNVKPQHNKGCNCRRSGCLKNYCECYEAQIMCSSICKCIGCKNYEESPERKTLMSMPNYMQTGGLEGSHYLPPTKFSGLPRFSHDRRPSSCISWEVVEATCACLLAQGEEAEKEHCSKCLAEQMILEEFGRCLSQILHTEFKSKGLKME

SEQ ID NO: 50671 - protein, 251 aa, Homo sapiens
  Payload ID: 10127
  Gene Symbol: MTL5
  Gene Name: metallothionein-like 5, testis-specific (tesmin)
  Uniprot ID: Q9Y4I5
  ENSP ID: ENSP00000403086
MEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMVICQLKGGTQMLCIDNSRTRELKALHLVPQYQDQNNYLQSA

SEQ ID NO: 50672 - protein, 306 aa, Homo sapiens
  Payload ID: 10127
  Gene Symbol: MTL5
  Gene Name: metallothionein-like 5, testis-specific (tesmin)
  Uniprot ID: Q9Y4I5
  ENSP ID: ENSP00000440968
MEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMVICQLKGGTQMLCIDNSRTRELKALHLVPQYQDQNNYLQSDVPKPMTALVGRFLPASTKLNLITQQLEGALPSVVNGSAFPSGSTLPGPPKITLAG

SEQ ID NO: 50673 - protein, 204 aa, Homo sapiens
  Payload ID: 10127
  Gene Symbol: MTL5
  Gene Name: metallothionein-like 5, testis-specific (tesmin)
  ENSP ID: ENSP00000454311
  MOD_RES (1)..(1): Any amino acid
XDCFASGDFCNNCNCNNCCNNLHHDIERFKAIKACLGRNPEAFQPKIGKGQLGNVKPQHNKGCNCRRSGCLKNYCECYEAQIMCSSICKCIGCKNYEESPERKTLMSMPNYMQTGGLEGSHYLPPTKFSGLPRFSHDRRPSSCISWEVVEATCACLLAQGEEAEKEHCSKCLAEQMILEEFGRNKFSGWAVVIPLKISRELLNT

SEQ ID NO: 50674 - protein, 753 aa, Homo sapiens
  Payload ID: 10128
  Gene Symbol: MTF1
  Gene Name: metal-regulatory transcription factor 1
  Uniprot ID: Q14872
  ENSP ID: ENSP00000362127
MGEHSPDNNIIYFEAEEDELTPDDKMLRFVDKNGLVPSSSGTVYDRTTVLIEQDPGTLEDEDDDGQCGEHLPFLVGGEEGFHLIDHEAMSQGYVQHIISPDQIHLTINPGSTPMPRNIEGATLTLQSECPETKRKEVKRYQCTFEGCPRTYSTAGNLRTHQKTHRGEYTFVCNQEGCGKAFLTSYSLRIHVRVHTKEKPFECDVQGCEKAFNTLYRLKAHQRLHTGKTFNCESEGCSKYFTTLSDLRKHIRTHTGEKPFRCDHDGCGKAFAASHHLKTHVRTHTGERPFFCPSNGCEKTFSTQYSLKSHMKGHDNKGHSYNALPQHNGSEDTNHSLCLSDLSLLSTDSELRENSSTTQGQDLSTISPAIIFESMFQNSDDTAIQEDPQQTASLTESFNGDAESVSDVPPSTGNSASLSLPLVLQPGLSEPPQPLLPASAPSAPPPAPSLGPGSQQAAFGNPPALLQPPEVPVPHSTQFAANHQEFLPHPQAPQPIVPGLSVVAGASASAAAVASAVAAPAPPQSTTEPLPAMVQTLPLGANSVLTNNPTITITPTPNTAILQSSLVMGEQNLQWILNGATSSPQNQEQIQQASKVEKVFFTTAVPVASSPGSSVQQIGLSVPVIIIKQEEACQCQCACRDSAKERASSRRKGCSSPPPPEPSPQAPDGPSLQLPAQTFSSAPVPGSSSSTLPSSCEQSRQAETPSDPQTETLSAMDVSEFLSLQSLDTPSNLIPIEALLQGEEEMGLTSSFSK

SEQ ID NO: 50675 - protein, 715 aa, Homo sapiens
  Payload ID: 10129
  Gene Symbol: MTA1
  Gene Name: metastasis associated 1
  Uniprot ID: Q13330
  ENSP ID: ENSP00000333633
MAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGGLKMPTRLDGERPGPNRSNMSPHGLPARSSGSPKFAMKTRQAFYLHTTKLTRIARRLCREILRPWHAARHPYLPINSAAIKAECTARLPEASQSPLVLKQAVRKPLEAVLRYLETHPRPPKPDPVKSVSSVLSSLTPAKVAPVINNGSPTILGKRSYEQHNGVDGNMKKRLLMPSRGLANHGQARHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 50676 - protein, 698 aa, Homo sapiens
  Payload ID: 10129
  Gene Symbol: MTA1
  Gene Name: metastasis associated 1
  Uniprot ID: Q13330
  ENSP ID: ENSP00000384180
MAANMYRVGDYVYFENSSSNPYLIRRIEELNKTANGNVEAKVVCFYRRRDISSTLIALADKHAREIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGGLKMPTRLDGERPGPNRSNMSPHGLPARSSGSPKFAMKTRQAFYLHTTKLTRIARRLCREILRPWHAARHPYLPINSAAIKAECTARLPEASQSPLVLKQAVRKPLEAVLRYLETHPRPPKPDPVKSVSSVLSSLTPAKVAPVINNGSPTILGKRSYEQHNGVDGNMKKRLLMPSRGLANHGQARHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 50677 - protein, 703 aa, Homo sapiens
  Payload ID: 10129
  Gene Symbol: MTA1
  Gene Name: metastasis associated 1
  ENSP ID: ENSP00000385702
MAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGGLKMPTRLDGERPGPNRSNMSPHGLPARSSGSPKFAMKTRQAFYLHTTKLTRIARRLCREILRPWHAARHPYLPINSAAIKAECTARLPEASQSPLVLKQAVRKPLEAVLRYLETHPRPPKPDPVKSVSSVLSSLTPAKVAPVINNGSPTILGKRSYEQHNGVDGLANHGQARHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 50678 - protein, 255 aa, Homo sapiens
  Payload ID: 10129
  Gene Symbol: MTA1
  Gene Name: metastasis associated 1
  ENSP ID: ENSP00000389425
MKTRQAFYLHTTKLTRIARRLCREILRPWHAARHPYLPINSAAIKAECTARLPEASQSPLVLKQAVRKPLEAVLRYLETHPRPPKPDPVKSVSSVLSSLTPAKVAPVINNGSPTILGKRSYEQHNGVDGNMKKRLLMPSRGTYLGLANHGQARHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 50679 - protein, 430 aa, Homo sapiens
  Payload ID: 10129
  Gene Symbol: MTA1
  Gene Name: metastasis associated 1
  Uniprot ID: Q13330
  ENSP ID: ENSP00000393438
MAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYMSSLRILLDILEEIWWLENANPVRWREARTKPQ

SEQ ID NO: 50680 - protein, 511 aa, Homo sapiens
  Payload ID: 10129
  Gene Symbol: MTA1
  Gene Name: metastasis associated 1
  ENSP ID: ENSP00000394106
QIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGGLKMPTRLDGERPGPNRSNMSPHGLPARSSGSPKFAMKTRQAFYLHTTKLTRIARRLCREILRPWHAARHPYLPINSAAIKAECTARLPEASQSPLVLKQAVRKPLEAVLRYLETHPRPPKPDPVKSVSSVLSSLTPAKVAPVINNGSPTILGKRSYEQHNGVDGNMKKRLLMPSRGTYLGLANHGQARHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 50681 - protein, 55 aa, Homo sapiens
  Payload ID: 10129
  Gene Symbol: MTA1
  Gene Name: metastasis associated 1
  ENSP ID: ENSP00000411493
  MOD_RES (1)..(1): Any amino acid
XRRIEELNKTANGNVEAKVVCFYRRRDISSTLIALADKHAMGGGVLAPFPRGLGE

SEQ ID NO: 50682 - protein, 57 aa, Homo sapiens
  Payload ID: 10129
  Gene Symbol: MTA1
  Gene Name: metastasis associated 1
  ENSP ID: ENSP00000450094
  MOD_RES (1)..(1): Any amino acid
XAAGPDMAANMYRVGDYVYFENSSSNPYLIRRIEELNKPCQSAIRPDRGRTTARKGK

SEQ ID NO: 50683 - protein, 668 aa, Homo sapiens
  Payload ID: 10130
  Gene Symbol: MTA2
  Gene Name: metastasis associated 1 family, member 2
  Uniprot ID: O94776
  ENSP ID: ENSP00000278823
MAANMYRVGDYVYFENSSSNPYLVRRIEELNKTANGNVEAKVVCLFRRRDISSSLNSLADSNAREFEEESKQPGVSEQQRHQLKHRELFLSRQFESLPATHIRGKCSVTLLNETDILSQYLEKEDCFFYSLVFDPVQKTLLADQGEIRVGCKYQAEIPDRLVEGESDNRNQQKMEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFLPWKSLASIVQFYYMWKTTDRYIQQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 50684 - protein, 495 aa, Homo sapiens
  Payload ID: 10130
  Gene Symbol: MTA2
  Gene Name: metastasis associated 1 family, member 2
  Uniprot ID: O94776
  ENSP ID: ENSP00000431346
MEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFLPWKSLASIVQFYYMWKTTDRYIQQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 50685 - protein, 495 aa, Homo sapiens; identical to SEQ ID NO: 50684
  Payload ID: 10130
  Gene Symbol: MTA2
  Gene Name: metastasis associated 1 family, member 2
  Uniprot ID: O94776
  ENSP ID: ENSP00000431797

SEQ ID NO: 50686 - protein, 537 aa, Homo sapiens
  Payload ID: 10131
  Gene Symbol: MTA3
  Gene Name: metastasis associated 1 family, member 3
  ENSP ID: ENSP00000383973
MLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAEYADRHAELSGSPLKSKSTRKPLACIIGYLEIHPAKKPNVIRSTPSLQTPTTKRMLTTPNHTSLSILGKRNYSHHNGLDELTCCVSD

SEQ ID NO: 50687 - protein, 537 aa, Homo sapiens; identical to SEQ ID NO: 50686
  Payload ID: 10131
  Gene Symbol: MTA3
  Gene Name: metastasis associated 1 family, member 3
  ENSP ID: ENSP00000384249

SEQ ID NO: 50688 - protein, 515 aa, Homo sapiens
  Payload ID: 10131
  Gene Symbol: MTA3
  Gene Name: metastasis associated 1 family, member 3
  Uniprot ID: Q9BTC8
  ENSP ID: ENSP00000385045
MAANMYRVGDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAECKMLLNS

SEQ ID NO: 50689 - protein, 514 aa, Homo sapiens
  Payload ID: 10131
  Gene Symbol: MTA3
  Gene Name: metastasis associated 1 family, member 3
  ENSP ID: ENSP00000385241
MAANMYRVGDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAECKMLLNS

SEQ ID NO: 50690 - protein, 594 aa, Homo sapiens
  Payload ID: 10131
  Gene Symbol: MTA3
  Gene Name: metastasis associated 1 family, member 3
  Uniprot ID: Q9BTC8
  ENSP ID: ENSP00000385823
MAANMYRVGDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYSKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAEYADRHAELSGSPLKSKSTRKPLACIIGYLEIHPAKKPNVIRSTPSLQTPTTKRMLTTPNHTSLSILGKRNYSHHNGLDELTCCVSD

SEQ ID NO: 50691 - protein, 590 aa, Homo sapiens
  Payload ID: 10131
  Gene Symbol: MTA3
  Gene Name: metastasis associated 1 family, member 3
  ENSP ID: ENSP00000386763
MAANMYRVGDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYKPNPNQISTSNGKPGAVNGAVGTTFQPQNPLLGRACESCYATQSHQWYSWGPPNMQCRLCAICWLYWKKYGGLKMPTQSEEEKLSPSPTTEDPRVRSHVSRQAMQGMPVRNTGSPKSAVKTRQAFFLHTTYFTKFARQVCKNTLRLRQAARRPFVAINYAAIRAEYADRHAELSGSPLKSKSTRKPLACIIGYLEIHPAKKPNVIRSTPSLQTPTTKRMLTTPNHTSLSILGKRNYSHHNGLDEKLMK

SEQ ID NO: 50692 - protein, 17 aa, Homo sapiens
  Payload ID: 10131
  Gene Symbol: MTA3
  Gene Name: metastasis associated 1 family, member 3
  ENSP ID: ENSP00000388722
MLADKHAKEIEEESETT

SEQ ID NO: 50693 - protein, 392 aa, Homo sapiens
  Payload ID: 10131
  Gene Symbol: MTA3
  Gene Name: metastasis associated 1 family, member 3
  ENSP ID: ENSP00000391455
MAANMYRVGDYVYFENSSSNPYLIRRIEELNKTASGNVEAKVVCFYRRRDISNTLIMLADKHAKEIEEESETTVEADLTDKQKHQLKHRELFLSRQYESLPATHIRGKCSVALLNETESVLSYLDKEDTFFYSLVYDPSLKTLLADKGEIRVGPRYQADIPEMLLEGESDEREQSKLEVKVWDPNSPLTDRQIDQFLVVARAVGTFARALDCSSSVRQPSLHMSAAAASRDITLFHAMDTLYRHSYDLSSAISVLVPLGGPVLCRDEMEEWSASEASLFEEALEKYGKDFNDIRQDFLPWKSLTSIIEYYYMWKTTDRYVQQKRLKAAEAESKLKQVYIPTYKPNPNQISTSNGKPGAVNGAVGTTFQPQNPLLGRACESCYVSPVVFLGPT

SEQ ID NO: 50694 - protein, 91 aa, Homo sapiens
  Payload ID: 10131
  Gene Symbol: MTA3
  Gene Name: metastasis associated 1 family, member 3
  ENSP ID: ENSP00000401815
MAANMYRVGDYVYFENSSSNPYLIRRIEELNKTASGNVEAKVVCFYRRRDISNTLIMLADKHAKTEFRSCCPGWSAMARSRLTATSTSQIK

SEQ ID NO: 50695 - protein, 852 aa, Homo sapiens
  Payload ID: 10132
  Gene Symbol: MACC1
  Gene Name: metastasis associated in colon cancer 1
  Uniprot ID: Q6ZN28
  ENSP ID: ENSP00000328410
MLITERKHFRSGRIAQSMSEANLIDMEAGKLSKSCNITECQDPDLLHNWPDAFTLRGNNASKVANPFWNQLSASNPFLDDITQLRNNRKRNNISILKEDPFLFCREIENGNSFDSSGDELDVHQLLRQTSSRNSGRSKSVSELLDILDDTAHAHQSIHNSDQILLHDLEWLKNDREAYKMAWLSQRQLARSCLDLNTISQSPGWAQTQLAEVTIACKVNHQGGSVQLPESDITVHVPQGHVAVGEFQEVSLRAFLDPPHMLNHDLSCTVSPLLEIMLGNLNTMEALLLEMKIGAEVRKDPFSQVMTEMVCLHSLGKEGPFKVLSNCYIYKDTIQVKLIDLSQVMYLVVAAQAKALPSPAATIWDYIHKTTSIGIYGPKYIHPSFTVVLTVCGHNYMPGQLTISDIKKGGKNISPVVFQLWGKQSFLLDKPQDLSISIFSCDPDFEVKTEGERKEIKQKQLEAGEVVHQQFLFSLVEHREMHLFDFCVQVEPPNGEPVAQFSITTPDPTPNLKRLSNLPGYLQKKEEIKSAPLSPKILVKYPTFQDKTLNFSNYGVTLKAVLRQSKIDYFLEYFKGDTIALLGEGKVKAIGQSKVKEWYVGVLRGKIGLVHCKNVKVISKEQVMFMSDSVFTTRNLLEQIVLPLKKLTYIYSVVLTLVSEKVYDWKVLADVLGYSHLSLEDFDQIQADKESEKVSYVIKKLKEDCHTERNTRKFLYELIVALLKMDCQELVARLIQEAAVLTSAVKLGKGWRELAEKLVRLTKQQMEAYEIPHRGNTGDVAVEMMWKPAYDFLYTWSAHYGNNYRDVLQDLQSALDRMKNPVTKHWRELTGVLILVNSLEVLRVTAFSTSEEV

SEQ ID NO: 50696 - protein, 852 aa, Homo sapiens; identical to SEQ ID NO: 50695
  Payload ID: 10132
  Gene Symbol: MACC1
  Gene Name: metastasis associated in colon cancer 1
  Uniprot ID: Q6ZN28
  ENSP ID: ENSP00000383185

SEQ ID NO: 50697 - protein, 852 aa, Homo sapiens; identical to SEQ ID NO: 50695
  Payload ID: 10132
  Gene Symbol: MACC1
  Gene Name: metastasis associated in colon cancer 1
  Uniprot ID: Q6ZN28
  ENSP ID: ENSP00000466864

SEQ ID NO: 50698 - protein, 759 aa, Homo sapiens
  Payload ID: 10133
  Gene Symbol: MTSS1
  Gene Name: metastasis suppressor 1
  Uniprot ID: O43312
  ENSP ID: ENSP00000322804
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKVDTLGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 50699 - protein, 730 aa, Homo sapiens
  Payload ID: 10133
  Gene Symbol: MTSS1
  Gene Name: metastasis suppressor 1
  Uniprot ID: O43312
  ENSP ID: ENSP00000367256
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQNSSSSASSEASETCQSVSECSSPTSVSSGSTMGAWVSTEKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 50700 - protein, 473 aa, Homo sapiens
  Payload ID: 10133
  Gene Symbol: MTSS1
  Gene Name: metastasis suppressor 1
  Uniprot ID: O43312
  ENSP ID: ENSP00000393606
MLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 50701 - protein, 207 aa, Homo sapiens
  Payload ID: 10133
  Gene Symbol: MTSS1
  Gene Name: metastasis suppressor 1
  ENSP ID: ENSP00000428145
MLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIP

SEQ ID NO: 50702 - protein, 645 aa, Homo sapiens
  Payload ID: 10133
  Gene Symbol: MTSS1
  Gene Name: metastasis suppressor 1
  ENSP ID: ENSP00000428319
MNKYFFYILENCGFDSSKDPREEGHLFQKLVFQQAVLGSLFFAGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 50703 - protein, 286 aa, Homo sapiens
  Payload ID: 10133
  Gene Symbol: MTSS1
  Gene Name: metastasis suppressor 1
  ENSP ID: ENSP00000428348
  MOD_RES (1)..(1): Any amino acid
XGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQDWAKPGPYDQPLVNTLQRRKEKREPDPNGGGPTTASGPPAAAEEAQRPRSMTVSAATRPGEEMEACEELALALSRGLQLDTQRSSRDSLQCSS

SEQ ID NO: 50704 - protein, 543 aa, Homo sapiens
  Payload ID: 10133
  Gene Symbol: MTSS1
  Gene Name: metastasis suppressor 1
  ENSP ID: ENSP00000428685
  MOD_RES (1)..(1): Any amino acid
XWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQNSSSSASSEASETCQSVSECSSPTSVSSGSTMGAWVSTEKLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 50705 - protein, 755 aa, Homo sapiens
  Payload ID: 10133
  Gene Symbol: MTSS1
  Gene Name: metastasis suppressor 1
  Uniprot ID: O43312
  ENSP ID: ENSP00000429064
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 50706 - protein, 184 aa, Homo sapiens
  Payload ID: 10133
  Gene Symbol: MTSS1
  Gene Name: metastasis suppressor 1
  ENSP ID: ENSP00000429752
  MOD_RES (1)..(1): Any amino acid
XSLGGSRHWLQVFPLSVPEGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALI

SEQ ID NO: 50707 - protein, 747 aa, Homo sapiens
  Payload ID: 10134
  Gene Symbol: MTSS1L
  Gene Name: metastasis suppressor 1-like
  Uniprot ID: Q765P7
  ENSP ID: ENSP00000341171
METAEKECGALGGLFQAIVNDMKSSYPIWEDFNSKATKLHSQLRTTVLAAVAFLDAFQKVADMATNTRGATRDIGSALTRMCMRHRSIETKLRQFTNALLESLINPLQERIEDWKKAANQLDKDHAKEYKRARHEIKKKSSDTLKLQKKARKELLGKGDLQPQLDSALQDVNDMYLLLEETEKQAVRRALIEERGRFCTFITFLQPVVNGELTMLGEITHLQGIIDDLVVLTAEPHKLPPASEQVIKDLKGSDYSWSYQTPPSSPSSSSSRKSSMCSAPSSSSSAKGGGAPWPGGAQTYSPSSTCRYRSLAQPATTTARLSSVSSHDSGFVSQDATYSKPPSPMPSDITSQKSSSSASSEASETCQSVSECSSPTSDWSKVGSHEQPSGATLQRRKDRVELLRDTEPGPASGGTLGPSGEEAPRPRMSPATIAAKHGEEVSPAASDLAMVLTRGLSLEHQKSSRDSLQYSSGYSTQTTTPSCSEDTIPSQGSDYDCYSVNGDADSEGPPEFDKSSTIPRNSNIAQNYRRLIQTKRPASTAGLPTAGLPTATGLPSGAPPGVATIRRTPSTKPTVRRALSSAGPIPIRPPIVPVKTPTVPDSPGYMGPTRAGSEECVFYTDETASPLAPDLAKASPKRLSLPNTAWGSPSPEAAGYPGAGAEDEQQQLAANRHSLVEKLGELVAGAHALGEGQFPFPTALSATPTEETPTPPPAATSDPPAEDMLVAIRRGVRLRRTVTNDRSAPRIL

SEQ ID NO: 50708 - protein, 136 aa, Homo sapiens
  Payload ID: 10134
  Gene Symbol: MTSS1L
  Gene Name: metastasis suppressor 1-like
  ENSP ID: ENSP00000455480
  MOD_RES (1)..(1): Any amino acid
XETEKQAVRRALIEERGRFCTFITFLQPVVNGELTMLGEITHLQGIIDDLVVLTAEPHKLPPASEQVIKDLKGSDYSWSYQTPPSSPSSSSSRKSSMCSLAQPATTTARLSSVSSHDSGFVSQDATYSKPPSPMPS

SEQ ID NO: 50709 - protein, 173 aa, Homo sapiens
  Payload ID: 10134
  Gene Symbol: MTSS1L
  Gene Name: metastasis suppressor 1-like
  ENSP ID: ENSP00000459654
  MOD_RES (1)..(1): Any amino acid
XRMCMRHRSIETKLRQFTNALLESLINPLQERIEDWKKAANQLDKDHAKEYKRARHEIKKKSSDTLKLQKKARKGKGDLQPQLDSALQDVNDMYLLLEETEKQAVRRALIEERGRFCTFITFLQPVVNGELTMLGEITHLQGIIDDLVVLTAEPHKLPPASEQVIKDLKGSDY

SEQ ID NO: 50710 - protein, 746 aa, Homo sapiens [sequence omitted]

SEQ ID NO: 50711 - protein, 57 aa, Homo sapiens
  Payload ID: 10135
  Gene Symbol:
  Gene Name: Metastasis-associated lung adenocarcinoma transcript 1  [Source:UniProtKB/Swiss-Prot
  Acc:Q9UHZ2]
  Uniprot ID: Q9UHZ2
  ENSP ID: ENSP00000485396
MQIMFSSVVRISGLCLFPNGGMTYNLFCLYLSIHQGAVFSASRPSYCQAGYDSEDVI

SEQ ID NO: 50712 - protein, 435 aa, Homo sapiens
  Payload ID: 10136
  Gene Symbol: MTX1
  Gene Name: metaxin 1
  ENSP ID: ENSP00000317106
MLLGGPPRSPRSGTSPKGPWSSTGHVQFGKSPQTWPRRTRPRSPEPAAPSGVRGSTWTRRRDSPRRAGPTALSRYVGHLWMGRRPPSPEARGPVPRSSAASRARRSLASPGISPGPLTATIGGAVAGGGPRQGRAEAHKEVFPGQRVGKMAAPMELFCWSGGWGLPSVDLDSLAVLTYARFTGAPLKVHKISNPWQSPSGTLPALRTSHGEVISVPHKIITHLRKEVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 50713 - protein, 466 aa, Homo sapiens
  Payload ID: 10136
  Gene Symbol: MTX1
  Gene Name: metaxin 1
  ENSP ID: ENSP00000357360
MLLGGPPRSPRSGTSPKGPWSSTGHVQFGKSPQTWPRRTRPRSPEPAAPSGVRGSTWTRRRDSPRRAGPTALSRYVGHLWMGRRPPSPEARGPVPRSSAASRARRSLASPGISPGPLTATIGGAVAGGGPRQGRAEAHKEVFPGQRVGKMAAPMELFCWSGGWGLPSVDLDSLAVLTYARFTGAPLKVHKISNPWQSPSGTLPALRTSHGEVISVPHKIITHLRKEKYNADYDLSARQGADTLAFMSLLEEKLLPVLVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 50714 - protein, 120 aa, Homo sapiens
  Payload ID: 10136
  Gene Symbol: MTX1
  Gene Name: metaxin 1
  ENSP ID: ENSP00000408749
MAAPMELFCWSGGWGLPSVDLDSLAVLTYARFTGAPLKVHKISNPWQSPSGTQYPLGELCLPFGPVMERSSQFHTRSSPTFEKRSTMLIMICQLGKGQTPWPSCLSWRRSCSRCWYILFG

SEQ ID NO: 50715 - protein, 317 aa, Homo sapiens
  Payload ID: 10136
  Gene Symbol: MTX1
  Gene Name: metaxin 1
  Uniprot ID: Q13505
  ENSP ID: ENSP00000476632
MAAPMELFCWSGGWGLPSVDLDSLAVLTYARFTGAPLKVHKISNPWQSPSGTLPALRTSHGEVISVPHKIITHLRKEKYNADYDLSARQGADTLAFMSLLEEKLLPVLVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 50716 - protein, 263 aa, Homo sapiens
  Payload ID: 10137
  Gene Symbol: MTX2
  Gene Name: metaxin 2
  Uniprot ID: O75431
  ENSP ID: ENSP00000249442
MSLVAEAFVSQIAAAEPWPENATLYQQLKGEQILLSDNAASLAVQAFLQMCNLPIKVVCRANAEYMSPSGKVPFIHVGNQVVSELGPIVQFVKAKGHSLSDGLEEVQKAEMKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 50717 - protein, 229 aa, Homo sapiens
  Payload ID: 10137
  Gene Symbol: MTX2
  Gene Name: metaxin 2
  ENSP ID: ENSP00000398757
MSLVAEAFVSQIAAAEPWPENATLYQQLKGEQILLSDNAASLAVQAFLQMCNLPIKVVCRANAEYMSPSGKVPFIHVGNQVVSELGPIVQFVKAKGHSLSDGLEEVQKAEMKAYMELVNNMLLTAELYLQWCDEATVGEWEVKRKMKAIGWGKKTLDQVLEDVDQCCQALSQRLGTQPYFFNKQPTELDALVFGHLYTILTTQLTNDELSEKVKNYSNLLAFCRRIEQH

SEQ ID NO: 50718 - protein, 45 aa, Homo sapiens
  Payload ID: 10137
  Gene Symbol: MTX2
  Gene Name: metaxin 2
  ENSP ID: ENSP00000402204
MSLVAEAFVSQIAAAEPWPENATLYQQLKGEQILLSDNAASLAVQ

SEQ ID NO: 50719 - protein, 37 aa, Homo sapiens
  Payload ID: 10137
  Gene Symbol: MTX2
  Gene Name: metaxin 2
  ENSP ID: ENSP00000403545
MSLVAEAFVSQIAGWSAVAQPGLTATSASRVQAILLP

SEQ ID NO: 50720 - protein, 207 aa, Homo sapiens
  Payload ID: 10137
  Gene Symbol: MTX2
  Gene Name: metaxin 2
  ENSP ID: ENSP00000414176
MSLVAEAFVSQIAGKVPFIHVGNQVVSELGPIVQFVKAKGHSLSDGLEEVQKAEMKAYMELVNNMLLTAELYLQWCDEATVGEITHARYGSPYPWPLNHILAYQKQWEVKRKMKAIGWGKKTLDQVLEDVDQCCQALSQRLGTQPYFFNKQPTELDALVFGHLYTILTTQLTNDELSEKVKNYSNLLAFCRRIEQHYFEDRGKGRLS

SEQ ID NO: 50721 - protein, 248 aa, Homo sapiens
  Payload ID: 10138
  Gene Symbol: MTX3
  Gene Name: metaxin 3
  Uniprot ID: Q5HYI7
  ENSP ID: ENSP00000423302
MAAPLELSCWGGGWGLPSVHSESLVVMAYAKFSGAPLKVNVIDNTWRGSRGDVPILTTEDDMVSQPAKILNFLRKQKYNADYELSAKQGADTLAYIALLEEKLLPAVLHTFWVESDNYFTVTKPWFASQIPFPLSLILPGRMSKGALNRILLTRGQPPLYHLREVEAQIYRDAKECLNLLSNRLGTSQFFFGDTPSTLDAYVFGFLAPLYKVRFPKVQLQEHLKQLSNLCRFCDDILSSYFRLSLGDG

SEQ ID NO: 50722 - protein, 251 aa, Homo sapiens
  Payload ID: 10138
  Gene Symbol: MTX3
  Gene Name: metaxin 3
  Uniprot ID: Q5HYI7
  ENSP ID: ENSP00000423600
MVSQPAKILNFLRKQKYNADYELSAKQGADTLAYIALLEEKLLPAVLHTFWVESDNYFTVTKPWFASQIPFPLSLILPGRMSKGALNRILLTRGQPPLYHLREVEAQIYRDAKECLNLLSNRLGTSQFFFGDTPSTLDAYVFGFLAPLYKVRFPKVQLQEHLKQLSNLCRFCDDILSSYFRLSLGGISPAGQETVDANLQKLTQLVNKESNLIEKMDDNLRQSPQLPPRKLPTLKLTPAEEENNSFQRLSP

SEQ ID NO: 50723 - protein, 312 aa, Homo sapiens
  Payload ID: 10138
  Gene Symbol: MTX3
  Gene Name: metaxin 3
  Uniprot ID: Q5HYI7
  ENSP ID: ENSP00000424798
MAAPLELSCWGGGWGLPSVHSESLVVMAYAKFSGAPLKVNVIDNTWRGSRGDVPILTTEDDMVSQPAKILNFLRKQKYNADYELSAKQGADTLAYIALLEEKLLPAVLHTFWVESDNYFTVTKPWFASQIPFPLSLILPGRMSKGALNRILLTRGQPPLYHLREVEAQIYRDAKECLNLLSNRLGTSQFFFGDTPSTLDAYVFGFLAPLYKVRFPKVQLQEHLKQLSNLCRFCDDILSSYFRLSLGGISPAGQETVDANLQKLTQLVNKESNLIEKMDDNLRQSPQLPPRKLPTLKLTPAEEENNSFQRLSP

SEQ ID NO: 50724 - protein, 158 aa, Homo sapiens
  Payload ID: 10138
  Gene Symbol: MTX3
  Gene Name: metaxin 3
  Uniprot ID: Q5HYI7
  ENSP ID: ENSP00000484157
MAAPLELSCWGGGWGLPSVHSESLVVMAYAKFSGAPLKVNVIDNTWRGSRGDVPILTTEDDMVSQPAKILNFLRKQKYNADYELSAKQGADTLAYIALLEEKLLPAVLHTFWVESDNYFTVTKPWFASQIPFPLSLILPGRMSQQILSSRAGTHMLRK

SEQ ID NO: 50725 - protein, 187 aa, Homo sapiens
  Payload ID: 10139
  Gene Symbol: METRN
  Gene Name: meteorin, glial cell differentiation regulator
  ENSP ID: ENSP00000219542
LAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFGECPRHGGSLEPAFP

SEQ ID NO: 50726 - protein, 293 aa, Homo sapiens
  Payload ID: 10139
  Gene Symbol: METRN
  Gene Name: meteorin, glial cell differentiation regulator
  Uniprot ID: Q9UJH8
  ENSP ID: ENSP00000455068
MGFPAAALLCALCCGLLAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVIHGIIHGVTHDVELQESVITVVAARVLRQTPPLFQAGRSGDQGLTSIRTPLRCGVHPGPGTFLFMGWSRFGEARLGCAPRFQEFRRAYEAARAAHLHPCEVALH

SEQ ID NO: 50727 - protein, 69 aa, Homo sapiens
  Payload ID: 10139
  Gene Symbol: METRN
  Gene Name: meteorin, glial cell differentiation regulator
  ENSP ID: ENSP00000456647
MGFPAAALLCALCCGLLAPAARAGYSEERCSWRGRPRRTRTSAAAWPPSALSCARTGAPSCPRRPTVSA

SEQ ID NO: 50728 - protein, 160 aa, Homo sapiens
  Payload ID: 10139
  Gene Symbol: METRN
  Gene Name: meteorin, glial cell differentiation regulator
  ENSP ID: ENSP00000457702
MLGCICQMGVQEGGPGQLIARHGPQAHVCVHSCLGGACRPCSDAELLLAACTSDFVIHGIIHGVTHDVELQESVITVVAARVLRQTPPLFQAGRSGDQGLTSIRTPLRCGVHPGPGTFLFMGWSRFGEARLGCAPRFQEFRRAYEAARAAHLHPCEVALH

SEQ ID NO: 50729 - protein, 175 aa, Homo sapiens
  Payload ID: 10139
  Gene Symbol: METRN
  Gene Name: meteorin, glial cell differentiation regulator
  ENSP ID: ENSP00000459900
  MOD_RES (1)..(1): Any amino acid
XAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVIHGIIHGVTHDVELQESVITVGGPTALEVMGLSIRTLFT

SEQ ID NO: 50730 - protein, 311 aa, Homo sapiens
  Payload ID: 10140
  Gene Symbol: METRNL
  Gene Name: meteorin, glial cell differentiation regulator-like
  Uniprot ID: Q641Q3
  ENSP ID: ENSP00000315731
MRGAARAAWGRAGQPWPRPPAPGPPPPPLPLLLLLLAGLLGGAGAQYSSDRCSWKGSGLTHEAHRKEVEQVYLRCAAGAVEWMYPTGALIVNLRPNTFSPARHLTVCIRSFTDSSGANIYLEKTGELRLLVPDGDGRPGRVQCFGLEQGGLFVEATPQQDIGRRTTGFQYELVRRHRASDLHELSAPCRPCSDTEVLLAVCTSDFAVRGSIQQVTHEPERQDSAIHLRVSRLYRQKSRVFEPVPEGDGHWQGRVRTLLECGVRPGHGDFLFTGHMHFGEARLGCAPRFKDFQRMYRDAQERGLNPCEVGTD

SEQ ID NO: 50731 - protein, 90 aa, Homo sapiens
  Payload ID: 10140
  Gene Symbol: METRNL
  Gene Name: meteorin, glial cell differentiation regulator-like
  ENSP ID: ENSP00000458275
RTAVRGSIQQVTHEPERQDSAIHLRVSRLYRQKSRVFEPVPEGDGHWQGRVRTLLECGARLGCAPRFKDFQRMYRDAQERGLNPCEVGTD

SEQ ID NO: 50732 - protein, 229 aa, Homo sapiens
  Payload ID: 10140
  Gene Symbol: METRNL
  Gene Name: meteorin, glial cell differentiation regulator-like
  Uniprot ID: Q641Q3
  ENSP ID: ENSP00000458566
MYPTGALIVNLRPNTFSPARHLTVCIRSFTDSSGANIYLEKTGELRLLVPDGDGRPGRVQCFGLEQGGLFVEATPQQDIGRRTTGFQYELVRRHRASDLHELSAPCRPCSDTEVLLAVCTSDFAVRGSIQQVTHEPERQDSAIHLRVSRLYRQKSRVFEPVPEGDGHWQGRVRTLLECGVRPGHGDFLFTGHMHFGEARLGCAPRFKDFQRMYRDAQERGLNPCEVGTD

SEQ ID NO: 50733 - protein, 229 aa, Homo sapiens; identical to SEQ ID NO: 50732
  Payload ID: 10140
  Gene Symbol: METRNL
  Gene Name: meteorin, glial cell differentiation regulator-like
  Uniprot ID: Q641Q3
  ENSP ID: ENSP00000460798

SEQ ID NO: 50734 - protein, 229 aa, Homo sapiens; identical to SEQ ID NO: 50732
  Payload ID: 10140
  Gene Symbol: METRNL
  Gene Name: meteorin, glial cell differentiation regulator-like
  Uniprot ID: Q641Q3
  ENSP ID: ENSP00000481759

SEQ ID NO: 50735 - protein, 311 aa, Homo sapiens; identical to SEQ ID NO: 50730
  Payload ID: 10140
  Gene Symbol: METRNL
  Gene Name: meteorin, glial cell differentiation regulator-like
  Uniprot ID: Q641Q3
  ENSP ID: ENSP00000488860

SEQ ID NO: 50736 - protein, 229 aa, Homo sapiens; identical to SEQ ID NO: 50732
  Payload ID: 10140
  Gene Symbol: METRNL
  Gene Name: meteorin, glial cell differentiation regulator-like
  Uniprot ID: Q641Q3
  ENSP ID: ENSP00000488881

SEQ ID NO: 50737 - protein, 383 aa, Homo sapiens
  Payload ID: 10141
  Gene Symbol: MTHFSD
  Gene Name: methenyltetrahydrofolate synthetase domain containing
  Uniprot ID: Q2M296
  ENSP ID: ENSP00000354152
MEPRAVGVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 50738 - protein, 383 aa, Homo sapiens
  Payload ID: 10141
  Gene Symbol: MTHFSD
  Gene Name: methenyltetrahydrofolate synthetase domain containing
  Uniprot ID: Q2M296
  ENSP ID: ENSP00000370612
MEPRAVGVSKQDIREQIWGYMESQNLADFPRPVHHRIPNFKGASHAAEQLPRLQAFKTARTIKVNPDAPQKSARFFVLESKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 50739 - protein, 220 aa, Homo sapiens
  Payload ID: 10141
  Gene Symbol: MTHFSD
  Gene Name: methenyltetrahydrofolate synthetase domain containing
  ENSP ID: ENSP00000438761
MMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 50740 - protein, 382 aa, Homo sapiens
  Payload ID: 10141
  Gene Symbol: MTHFSD
  Gene Name: methenyltetrahydrofolate synthetase domain containing
  Uniprot ID: Q2M296
  ENSP ID: ENSP00000444003
MEPRAGVSKQDIREQIWGYMESQNLADFPRPVHHRIPNFKGASHAAEQLPRLQAFKTARTIKVNPDAPQKSARFFVLESKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 50741 - protein, 16 aa, Homo sapiens
  Payload ID: 10141
  Gene Symbol: MTHFSD
  Gene Name: methenyltetrahydrofolate synthetase domain containing
  ENSP ID: ENSP00000454429
MMVSMGAVSKETPVVT

SEQ ID NO: 50742 - protein, 56 aa, Homo sapiens
  Payload ID: 10141
  Gene Symbol: MTHFSD
  Gene Name: methenyltetrahydrofolate synthetase domain containing
  ENSP ID: ENSP00000454593
MEPRAGVSKQDIREQIWGYMESQNLADFPRPVHHRIPNFKAGESGREKATPIWNMP

SEQ ID NO: 50743 - protein, 174 aa, Homo sapiens
  Payload ID: 10141
  Gene Symbol: MTHFSD
  Gene Name: methenyltetrahydrofolate synthetase domain containing
  ENSP ID: ENSP00000454807
MEPRAGVSKQDIREQIWGYMESQNLADFPRPVHHRIPNFKSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIAT

SEQ ID NO: 50744 - protein, 112 aa, Homo sapiens
  Payload ID: 10141
  Gene Symbol: MTHFSD
  Gene Name: methenyltetrahydrofolate synthetase domain containing
  ENSP ID: ENSP00000455208
MESQNLADFPRPVHHRIPNFKGSYLACQNIKDLDVFARTQEVKVDPDKPLEGVRLLVLQSKKTLLVPTPRLRTGLFNKITPPPGATKDILRKCATSQVPPERLGRQDRISKT

SEQ ID NO: 50745 - protein, 106 aa, Homo sapiens
  Payload ID: 10141
  Gene Symbol: MTHFSD
  Gene Name: methenyltetrahydrofolate synthetase domain containing
  ENSP ID: ENSP00000455262
MEPRAVGVSKQDIREQIWGYMESQNLADFPRPVHHRIPNFKSKKTLLVPTPRLRTGLFNKITPPPGATKDILRKCATSQVPPERLGRQDRISKTCSIGNCLTSSKV

SEQ ID NO: 50746 - protein, 233 aa, Homo sapiens
  Payload ID: 10141
  Gene Symbol: MTHFSD
  Gene Name: methenyltetrahydrofolate synthetase domain containing
  ENSP ID: ENSP00000455940
  MOD_RES (1)..(1): Any amino acid
XVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKVGHGSGQLWPVA

SEQ ID NO: 50747 - protein, 18 aa, Homo sapiens
  Payload ID: 10141
  Gene Symbol: MTHFSD
  Gene Name: methenyltetrahydrofolate synthetase domain containing
  ENSP ID: ENSP00000456628
MMVSMGAVSKETPVVTIV

SEQ ID NO: 50748 - protein, 223 aa, Homo sapiens
  Payload ID: 10141
  Gene Symbol: MTHFSD
  Gene Name: methenyltetrahydrofolate synthetase domain containing
  ENSP ID: ENSP00000456652
GVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKIR

SEQ ID NO: 50749 - protein, 84 aa, Homo sapiens
  Payload ID: 10141
  Gene Symbol: MTHFSD
  Gene Name: methenyltetrahydrofolate synthetase domain containing
  ENSP ID: ENSP00000456910
MEPRAVGVSKQDIREQIWGYMESQNLADFPRPVHHRIPNFKGSYLACQNIKDLDVFARTQEVKVDPDKPLEGVRLLVLQVIPLP

SEQ ID NO: 50750 - protein, 89 aa, Homo sapiens
  Payload ID: 10141
  Gene Symbol: MTHFSD
  Gene Name: methenyltetrahydrofolate synthetase domain containing
  ENSP ID: ENSP00000457794
MESQNLADFPRPVHHRIPNFKGSYLACQNIKDLDVFARTQEVKVDPDKPLEGVRLLVLQSKKTLLVPTPRLRTGLFNKITPPPGATKDI

SEQ ID NO: 50751 - protein, 112 aa, Homo sapiens
  Payload ID: 10141
  Gene Symbol: MTHFSD
  Gene Name: methenyltetrahydrofolate synthetase domain containing
  ENSP ID: ENSP00000458104
MESQNLADFPRPVHHRIPNFKGASHAAEQLPRLQAFKTARTIKVNPDAPQKSARFFVLESKKTLLVPTPRLRTGLFNKITPPPGATKDILRKCATSQGVRNYSVPIGLDSRV

SEQ ID NO: 50752 - protein, 152 aa, Homo sapiens
  Payload ID: 10141
  Gene Symbol: MTHFSD
  Gene Name: methenyltetrahydrofolate synthetase domain containing
  ENSP ID: ENSP00000480673
PRAVGVSKQDIREQIWGYMESQNLADFPRPVHHRIPNFKGASHAAEQLPRLQAFKTARTIKVNPDAPQKSARFFVLESKKTLLVPTPRLRTGLFNKITPPPGATKDILRKCATSQVPPERLGRQDRISKTCSIGNCLTSSNWSVPAPVDPAR

SEQ ID NO: 50753 - protein, 382 aa, Homo sapiens
  Payload ID: 10141
  Gene Symbol: MTHFSD
  Gene Name: methenyltetrahydrofolate synthetase domain containing
  ENSP ID: ENSP00000489295
MEPRAGVSKQDIREQIWGYMESQNLADFPRPVHHRIPNFKGSYLACQNIKDLDVFARTQEVKVDPDKPLEGVRLLVLQSKKTLLVPTPRLRTGLFNKITPPPGATKDILRKCATSQGVRNYSVPIGLDSRVLVDLVVVGSVAVSEKGWRIGKGEGYADLEYAMMVSMGAVSKETPVVTIVHDCQVVDIPEELVEEHDITVDYILTPTRVIATGCKRPKPMGITWFKISLEMMEKIPILRSLRAREQQAGKDVTLQGEHQHLPEPGCQQTVPLSVGRRPPDTPGPETNSMEAAPGSPPGEGAPLAADVYVGNLPGDARVSDLKRALRELGSVPLRLTWQGPRRRAFLHYPDSAAAQQAVSCLQGLRLGTDTLRVALARQQRDK

SEQ ID NO: 50754 - protein, 395 aa, Homo sapiens
  Payload ID: 10142
  Gene Symbol: MAT1A
  Gene Name: methionine adenosyltransferase I, alpha
  Uniprot ID: Q00266
  ENSP ID: ENSP00000361287
MNGPVDGLCDHSLSEGVFMFTSESVGEGHPDKICDQISDAVLDAHLKQDPNAKVACETVCKTGMVLLCGEITSMAMVDYQRVVRDTIKHIGYDDSAKGFDFKTCNVLVALEQQSPDIAQCVHLDRNEEDVGAGDQGLMFGYATDETEECMPLTIILAHKLNARMADLRRSGLLPWLRPDSKTQVTVQYMQDNGAVIPVRIHTIVISVQHNEDITLEEMRRALKEQVIRAVVPAKYLDEDTVYHLQPSGRFVIGGPQGDAGVTGRKIIVDTYGGWGAHGGGAFSGKDYTKVDRSAAYAARWVAKSLVKAGLCRRVLVQVSYAIGVAEPLSISIFTYGTSQKTERELLDVVHKNFDLRPGVIVRDLDLKKPIYQKTACYGHFGRSEFPWEVPRKLVF

SEQ ID NO: 50755 - protein, 145 aa, Homo sapiens
  Payload ID: 10142
  Gene Symbol: MAT1A
  Gene Name: methionine adenosyltransferase I, alpha
  ENSP ID: ENSP00000414961
ESVGEGHPDKICDQISDAVLDAHLKQDPNAKVACGFDFKTCNVLVALEQQSPDIAQCVHLDRNEEDVGAGDQGLMFGYATDETEECMPLTIILAHKLNARMADLRRSGLLPWLRPDSKTQVTVQYMQDNGAVIPVRIHTIVISVQ

SEQ ID NO: 50756 - protein, 395 aa, Homo sapiens
  Payload ID: 10143
  Gene Symbol: MAT2A
  Gene Name: methionine adenosyltransferase II, alpha
  Uniprot ID: P31153
  ENSP ID: ENSP00000303147
MNGQLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 50757 - protein, 299 aa, Homo sapiens
  Payload ID: 10143
  Gene Symbol: MAT2A
  Gene Name: methionine adenosyltransferase II, alpha
  Uniprot ID: P31153
  ENSP ID: ENSP00000386353
MILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVR

SEQ ID NO: 50758 - protein, 323 aa, Homo sapiens
  Payload ID: 10144
  Gene Symbol: MAT2B
  Gene Name: methionine adenosyltransferase II, beta
  Uniprot ID: Q9NZL9
  ENSP ID: ENSP00000280969
MPEMPEDMEQEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 50759 - protein, 334 aa, Homo sapiens
  Payload ID: 10144
  Gene Symbol: MAT2B
  Gene Name: methionine adenosyltransferase II, beta
  Uniprot ID: Q9NZL9
  ENSP ID: ENSP00000325425
MVGREKELSIHFVPGSCRLVEEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLDPSIKGTFHWSGNEQMTKYEMACAIADAFNLPSSHLRPITDSPVLGAQRPRNAQLDCSKLETLGIGQRTPFRIGIKESLWPFLIDKRWRQTVFH

SEQ ID NO: 50760 - protein, 198 aa, Homo sapiens
  Payload ID: 10144
  Gene Symbol: MAT2B
  Gene Name: methionine adenosyltransferase II, beta
  ENSP ID: ENSP00000397371
MVGREKELSIHFVPGSCRLVEPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLDPSIKGTFHWSGNEQMTKYEMAC

SEQ ID NO: 50761 - protein, 259 aa, Homo sapiens
  Payload ID: 10144
  Gene Symbol: MAT2B
  Gene Name: methionine adenosyltransferase II, beta
  Uniprot ID: Q9NZL9
  ENSP ID: ENSP00000428046
MVGREKELSIHFVPGSCRLVEEEVNIPNRRVLVTGATGLLGRAVHKEFQQNNWHAVGCGFRRARPKFEQVNLLDSNAVHHIIHDFQPHVIVHCAAERRPDVVENQPDAASQLNVDASGNLAKEAAAVGAFLIYISSDYVFDGTNPPYREEDIPAPLNLYGKTKLDGEKAVLENNLGAAVLRIPILYGEVEKLEESAVTVMFDKVQFSNKSANMDHWQQRFPTHVKDVATVCRQLAEKRMLVRRIPESCLSEGPLCLFHA

SEQ ID NO: 50762 - protein, 117 aa, Homo sapiens
  Payload ID: 10144
  Gene Symbol: MAT2B
  Gene Name: methionine adenosyltransferase II, beta
  ENSP ID: ENSP00000431071
MVGREKELSIHFVPGSCRLVEEEVNIPNRRVLVTGATGLLGRAVHKEFQQNNWHAVGCGFRRARPKFEQVNLLDSNAVHHIIHDFQLLLEHFSSTLAQIMYLMEQIHLTERKTYQLP

SEQ ID NO: 50763 - protein, 235 aa, Homo sapiens
  Payload ID: 10145
  Gene Symbol: MSRA
  Gene Name: methionine sulfoxide reductase A
  Uniprot ID: Q9UJ68
  ENSP ID: ENSP00000313921
MLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 50764 - protein, 192 aa, Homo sapiens
  Payload ID: 10145
  Gene Symbol: MSRA
  Gene Name: methionine sulfoxide reductase A
  Uniprot ID: Q9UJ68
  ENSP ID: ENSP00000371930
MCSEPKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 50765 - protein, 195 aa, Homo sapiens
  Payload ID: 10145
  Gene Symbol: MSRA
  Gene Name: methionine sulfoxide reductase A
  Uniprot ID: Q9UJ68
  ENSP ID: ENSP00000410912
MLSATRRACQLLLLHSLFPVPRMGNSASNIVSPQEALPGRKEQTPVAAKHHVNGNRTVEPFPEGTQMAVFEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 50766 - protein, 91 aa, Homo sapiens
  Payload ID: 10145
  Gene Symbol: MSRA
  Gene Name: methionine sulfoxide reductase A
  ENSP ID: ENSP00000427725
  MOD_RES (1)..(1): Any amino acid
XKTGHAEVVRVVYQPEHMSFEELLKVFWENHDPTQGMRQGNDHGTQYRSAIYPTSAKQMEAALSSKENYQKVPKHVHWKKRTQTGLQTEGR

SEQ ID NO: 50767 - protein, 82 aa, Homo sapiens
  Payload ID: 10145
  Gene Symbol: MSRA
  Gene Name: methionine sulfoxide reductase A
  ENSP ID: ENSP00000428214
MAVFGMGCFWGAERKFWVLKGVYSTQVGFAGGYTSNPTYKEVCSEKTGHAEVVRVVYQPEHMSFEELLKVFWENHDPTQGMR

SEQ ID NO: 50768 - protein, 213 aa, Homo sapiens
  Payload ID: 10145
  Gene Symbol: MSRA
  Gene Name: methionine sulfoxide reductase A
  ENSP ID: ENSP00000429461
MLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKLVLPCSSSAMLGLTAASSAQLAWVQPSSRKHY

SEQ ID NO: 50769 - protein, 59 aa, Homo sapiens
  Payload ID: 10145
  Gene Symbol: MSRA
  Gene Name: methionine sulfoxide reductase A
  ENSP ID: ENSP00000435644
MAVFGMGCFWGAERKFWVLKGVYSTQVGFAGGYTSNPTYKEVCSDVQNNSMFISLFKSF

SEQ ID NO: 50770 - protein, 169 aa, Homo sapiens
  Payload ID: 10145
  Gene Symbol: MSRA
  Gene Name: methionine sulfoxide reductase A
  Uniprot ID: Q9UJ68
  ENSP ID: ENSP00000436839
MAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 50771 - protein, 116 aa, Homo sapiens
  Payload ID: 10146
  Gene Symbol: MSRB1
  Gene Name: methionine sulfoxide reductase B1
  Uniprot ID: Q9NZV6
  ENSP ID: ENSP00000355084
  MOD_RES (95)..(95): Selenocysteine
MSFCSFFGGEVFQNHFEPGVYVCAKCGYELFSSRSKYAHSSPWPAFTETIHADSVAKRPEHNRSEALKVSCGKCGNGLGHEFLNDGPKPGQSRFXIFSSSLKFVPKGKETSASQGH

SEQ ID NO: 50772 - protein, 226 aa, Homo sapiens
  Payload ID: 10146
  Gene Symbol: MSRB1
  Gene Name: methionine sulfoxide reductase B1
  ENSP ID: ENSP00000382657
MSFCSFFGGEVFQNHFEPGVYVCAKCGYELFSSRSKYAHSSPWPAFTETIHADSVAKRPEHNRSEALKVRGHRGGGGTGAARESREPVPPSSLCLPHSSRGLEASIPGLLPLPGSCHPRLSGEPGLLVQMWETGQVSCTGSRTKVNLLCRRSAWEIGVWEETPSASPSKGLHCGCIMARSSPSCLVIFPGVLWQVWQWVGPRVPERRPQAGAVPILNIQQLAEVCP

SEQ ID NO: 50773 - protein, 151 aa, Homo sapiens
  Payload ID: 10146
  Gene Symbol: MSRB1
  Gene Name: methionine sulfoxide reductase B1
  ENSP ID: ENSP00000456557
MSFCSFFGGEVFQNHFEPGVYVCAKCGYELFSSRSKYAHSSPWPAFTETIHADSVAKRPEHNRSEALKLQGLRGVYSRPVASARELPPQAIGRAWPSGANVGNRTGFLYGLQDKGVLWQVWQWVGPRVPERRPQAGAVPILNIQQLAEVCP

SEQ ID NO: 50774 - protein, 56 aa, Homo sapiens
  Payload ID: 10146
  Gene Symbol: MSRB1
  Gene Name: methionine sulfoxide reductase B1
  ENSP ID: ENSP00000457320
  MOD_RES (1)..(1): Any amino acid
XSRITLNLAFTCVPSVAMSCSPAARSMHTRLHGRRSPRPFTPTAWPSVRSTIDLKP

SEQ ID NO: 50775 - protein, 115 aa, Homo sapiens
  Payload ID: 10146
  Gene Symbol: MSRB1
  Gene Name: methionine sulfoxide reductase B1
  ENSP ID: ENSP00000480943
MSFCSFFGGEVFQNHFEPGVYVCAKCGYELFSSRSKYAHSSPWPAFTETIHADSVAKRPEHNRSEALKVSCGKCGNGLGHEFLNDGPKPGQSRFIFSSSLKFVPKGKETSASQGH

SEQ ID NO: 50776 - protein, 182 aa, Homo sapiens
  Payload ID: 10147
  Gene Symbol: MSRB2
  Gene Name: methionine sulfoxide reductase B2
  Uniprot ID: Q9Y3D2
  ENSP ID: ENSP00000365693
MARLLWLLRGLTLGTAPRRAVRGQAGGGGPGTGPGLGEAGSLATCELPLAKSEWQKKLTPEQFYVTREKGTEPPFSGIYLNNKEAGMYHCVCCDSPLFSSEKKYCSGTGWPSFSEAHGTSGSDESHTGILRRLDTSLGSARTEVVCKQCEAHLGHVFPDGPGPNGQRFCINSVALKFKPRKH

SEQ ID NO: 50777 - protein, 120 aa, Homo sapiens
  Payload ID: 10147
  Gene Symbol: MSRB2
  Gene Name: methionine sulfoxide reductase B2
  ENSP ID: ENSP00000434990
  MOD_RES (1)..(1): Any amino acid
XSLATCELPLAKSEWQKKLTPEQFYVTREKGTEPPFSGIYLNNKEAGMYHCVCCDSPLFRSLLDIQKEVFSIKGSRSPSTSRGNGFDSEVLRKSTALALGGLRFPRLMVRLALMKATQGS

SEQ ID NO: 50778 - protein, 185 aa, Homo sapiens
  Payload ID: 10148
  Gene Symbol: MSRB3
  Gene Name: methionine sulfoxide reductase B3
  Uniprot ID: Q8IXL7
  ENSP ID: ENSP00000312274
MSAFNLLHLVTKSQPVALRACGLPSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQCGAHLGHIFDDGPRPTGKRYCINSAALSFTPADSSGTAEGGSGVASPAQADKAEL

SEQ ID NO: 50779 - protein, 192 aa, Homo sapiens
  Payload ID: 10148
  Gene Symbol: MSRB3
  Gene Name: methionine sulfoxide reductase B3
  Uniprot ID: Q8IXL7
  ENSP ID: ENSP00000347324
MSPRRTLPRPLSLCLSLCLCLCLAAALGSAQSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQCGAHLGHIFDDGPRPTGKRYCINSAALSFTPADSSGTAEGGSGVASPAQADKAEL

SEQ ID NO: 50780 - protein, 117 aa, Homo sapiens
  Payload ID: 10148
  Gene Symbol: MSRB3
  Gene Name: methionine sulfoxide reductase B3
  ENSP ID: ENSP00000404903
  MOD_RES (1)..(1): Any amino acid
XLRKRLTPLQYHVTQEKGTESAFEGEYTHHKDPGIYKCVVCGTPLFKSETKFDSGSGWPSFHDVINSEAITFTDDFSYGMHRVETSCSQQEGPHQMLPLNLGFPGLQNCEPINFYSF

SEQ ID NO: 50781 - protein, 160 aa, Homo sapiens
  Payload ID: 10148
  Gene Symbol: MSRB3
  Gene Name: methionine sulfoxide reductase B3
  ENSP ID: ENSP00000437623
MSPRRTLPRPLSLCLSLCLCLCLAAALGSAQSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQVSSSFLKTQYIAFRTPGCAKYSN

SEQ ID NO: 50782 - protein, 174 aa, Homo sapiens
  Payload ID: 10148
  Gene Symbol: MSRB3
  Gene Name: methionine sulfoxide reductase B3
  ENSP ID: ENSP00000440722
  MOD_RES (1)..(1): Any amino acid
XRRRLPGLSMSPRRTLPRPLSLCLSLCLCLCLAAALGSAQSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQQEGPHQMLPLNLGFPGLQNCEPINFYSF

SEQ ID NO: 50783 - protein, 185 aa, Homo sapiens; identical to SEQ ID NO: 50778
  Payload ID: 10148
  Gene Symbol: MSRB3
  Gene Name: methionine sulfoxide reductase B3
  Uniprot ID: Q8IXL7
  ENSP ID: ENSP00000441650

SEQ ID NO: 50784 - protein, 117 aa, Homo sapiens
  Payload ID: 10148
  Gene Symbol: MSRB3
  Gene Name: methionine sulfoxide reductase B3
  ENSP ID: ENSP00000442620
MSAFNLLHLVTKSQPVALRACGLPSGSCRDKKNCKVVFSQQELRKRLTPLQYHVTQEKGTESAFEGEYTHHKDPGIYKCVVCGTPLFKSETKFDSGSGWPSFHDVINSEAITFTDDF

SEQ ID NO: 50785 - protein, 44 aa, Homo sapiens
  Payload ID: 10148
  Gene Symbol: MSRB3
  Gene Name: methionine sulfoxide reductase B3
  ENSP ID: ENSP00000445051
MSPRRTLPRPLSLCLSLCLCLCLAAALGSAQSALAPVLCFSFCW

SEQ ID NO: 50786 - protein, 164 aa, Homo sapiens
  Payload ID: 10148
  Gene Symbol: MSRB3
  Gene Name: methionine sulfoxide reductase B3
  ENSP ID: ENSP00000445843
MSAFNLLHLVTKSQPVALRACGLPSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQCGAHLGHIFDDGPRPTGKRYCINSAALSFTPADS

SEQ ID NO: 50787 - protein, 185 aa, Homo sapiens; identical to SEQ ID NO: 50778
  Payload ID: 10148
  Gene Symbol: MSRB3
  Gene Name: methionine sulfoxide reductase B3
  Uniprot ID: Q8IXL7
  ENSP ID: ENSP00000481483

SEQ ID NO: 50788 - protein, 386 aa, Homo sapiens [sequence omitted]

SEQ ID NO: 50789 - protein, 116 aa, Homo sapiens
  Payload ID: 10149
  Gene Symbol: METAP1
  Gene Name: methionyl aminopeptidase 1
  ENSP ID: ENSP00000422689
LYRNGYHGDLNETFFVGEVDDGARKLVQTTYECLMQAIDAENKAVGVMKSGHVFTIEPMICEGGWQDETWPDGWTAVTRDGKRSAQFEHTLLVTDTGCEILTRRLDSARPHFMSQF

SEQ ID NO: 50790 - protein, 170 aa, Homo sapiens
  Payload ID: 10149
  Gene Symbol: METAP1
  Gene Name: methionyl aminopeptidase 1
  ENSP ID: ENSP00000423071
ACIARNCYPSPLNYYNFPKSCCTSVNEVICHGIPDRRPLQEGDIVNVKPGVRYRELGNIIQKHAQANGFSVVRSYCGHGIHKLFHTAPNVPHYAKNKAVGVMKSGHVFTIEPMICEGGWQDETWPDGWTAVTRDGKRSAQFEHTLLVTDTGCEILTRRLDSARPHFMSQF

SEQ ID NO: 50791 - protein, 44 aa, Homo sapiens
  Payload ID: 10149
  Gene Symbol: METAP1
  Gene Name: methionyl aminopeptidase 1
  ENSP ID: ENSP00000424462
ETRVCETDGCSSEAKLQCPTCIKLGIQGSYFCSQQRGRNQRLLF

SEQ ID NO: 50792 - protein, 48 aa, Homo sapiens
  Payload ID: 10149
  Gene Symbol: METAP1
  Gene Name: methionyl aminopeptidase 1
  ENSP ID: ENSP00000426702
MAAVETRVCETDGCSSEAKLQCPTCIKLGIQGSYFCSQQRGRNQRLLF

SEQ ID NO: 50793 - protein, 38 aa, Homo sapiens
  Payload ID: 10149
  Gene Symbol: METAP1
  Gene Name: methionyl aminopeptidase 1
  ENSP ID: ENSP00000427187
  MOD_RES (1)..(1): Any amino acid
XKLGIQGSYFCSQECFKGSWATHKLLHKKAKRRCYVMS

SEQ ID NO: 50794 - protein, 48 aa, Homo sapiens; identical to SEQ ID NO: 50792
  Payload ID: 10149
  Gene Symbol: METAP1
  Gene Name: methionyl aminopeptidase 1
  ENSP ID: ENSP00000427563

SEQ ID NO: 50795 - protein, 48 aa, Homo sapiens; identical to SEQ ID NO: 50792
  Payload ID: 10149
  Gene Symbol: METAP1
  Gene Name: methionyl aminopeptidase 1
  ENSP ID: ENSP00000485924

SEQ ID NO: 50796 - protein, 455 aa, Homo sapiens
  Payload ID: 10150
  Gene Symbol: METAP2
  Gene Name: methionyl aminopeptidase 2
  Uniprot ID: P50579
  ENSP ID: ENSP00000261220
MAGVEEVAASGSHLNGDLDPDDREEGAASTAEEAAKKKRRKKKKSKGPSAGEQEPDKESGASVDEVARQLERSALEDKERDEDDEAKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVKPIRNLNGHSIGQYRIHAGKTVPIVKGGEATRMEEGEVYAIETFGSTGKGVVHDDMECSHYMKNFDVGHVPIRLPRTKHLLNVINENFGTLAFCRRWLDRLGESKYLMALKNLCDLGIVDPYPPLCDIKGSYTAQFEHTILLRPTCKEVVSRGDDY

SEQ ID NO: 50797 - protein, 478 aa, Homo sapiens
  Payload ID: 10150
  Gene Symbol: METAP2
  Gene Name: methionyl aminopeptidase 2
  Uniprot ID: P50579
  ENSP ID: ENSP00000325312
MAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVKPIRNLNGHSIGQYRIHAGKTVPIVKGGEATRMEEGEVYAIETFGSTGKGVVHDDMECSHYMKNFDVGHVPIRLPRTKHLLNVINENFGTLAFCRRWLDRLGESKYLMALKNLCDLGIVDPYPPLCDIKGSYTAQFEHTILLRPTCKEVVSRGDDY

SEQ ID NO: 50798 - protein, 328 aa, Homo sapiens
  Payload ID: 10150
  Gene Symbol: METAP2
  Gene Name: methionyl aminopeptidase 2
  ENSP ID: ENSP00000446052
MAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQGRRSICN

SEQ ID NO: 50799 - protein, 163 aa, Homo sapiens
  Payload ID: 10150
  Gene Symbol: METAP2
  Gene Name: methionyl aminopeptidase 2
  ENSP ID: ENSP00000447661
MCGFCVGLISAKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGKFL

SEQ ID NO: 50800 - protein, 455 aa, Homo sapiens
  Payload ID: 10150
  Gene Symbol: METAP2
  Gene Name: methionyl aminopeptidase 2
  Uniprot ID: P50579
  ENSP ID: ENSP00000448169
MAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGRQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVKPIRNLNGHSIGQYRIHAGKTVPIVKGGEATRMEEGEVYAIETFGSTGKGVVHDDMECSHYMKNFDVGHVPIRLPRTKHLLNVINENFGTLAFCRRWLDRLGESKYLMALKNLCDLGIVDPYPPLCDIKGSYTAQFEHTILLRPTCKEVVSRGDDY

SEQ ID NO: 50801 - protein, 161 aa, Homo sapiens
  Payload ID: 10150
  Gene Symbol: METAP2
  Gene Name: methionyl aminopeptidase 2
  ENSP ID: ENSP00000448370
MAGVEEVAASGSHLNGDLDPDDREEGAASTAEEAAKKKRRKKKKSKGPSAAGEQEPDKESGASVDEVARQLERSALEDKERDEDDEGYKISLPSPRLTCCGSISAHCSLDFPGSDGDGDGDGATGKKKKKKKKKRGPKVQTDPPSVPICDLYPNGVFPKGQ

SEQ ID NO: 50802 - protein, 442 aa, Homo sapiens
  Payload ID: 10150
  Gene Symbol: METAP2
  Gene Name: methionyl aminopeptidase 2
  ENSP ID: ENSP00000448614
MAGVEEVAASGSHLNGDLDPDDREEGAASTAEEAAKKKRRKKKKSKGPSADGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVKPIRNLNGHSIGQYRIHAGKTVPIVKGGEATRMEEGEVYAIETFGSTGKGVVHDDMECSHYMKNFDVGHVPIRLPRTKHLLNVINENFGTLAFCRRWLDRLGESKYLMALKNLCDLGIVDPYPPLCDIKGSYTAQFEHTILLRPTCKEVVSRGDDY

SEQ ID NO: 50803 - protein, 178 aa, Homo sapiens
  Payload ID: 10150
  Gene Symbol: METAP2
  Gene Name: methionyl aminopeptidase 2
  ENSP ID: ENSP00000449004
MAGVEEVAASGSHLNGDLDPDDREEGAASTAEEAAKKKRRKKKKSKGPSAALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLED

SEQ ID NO: 50804 - protein, 477 aa, Homo sapiens
  Payload ID: 10150
  Gene Symbol: METAP2
  Gene Name: methionyl aminopeptidase 2
  ENSP ID: ENSP00000450063
MAGVEEVAASGSHLNGDLDPDDREEGAASTAEEAAKKKRRKKKKSKGPSAGEQEPDKESGASVDEVARQLERSALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVKPIRNLNGHSIGQYRIHAGKTVPIVKGGEATRMEEGEVYAIETFGSTGKGVVHDDMECSHYMKNFDVGHVPIRLPRTKHLLNVINENFGTLAFCRRWLDRLGESKYLMALKNLCDLGIVDPYPPLCDIKGSYTAQFEHTILLRPTCKEVVSRGDDY

SEQ ID NO: 50805 - protein, 335 aa, Homo sapiens
  Payload ID: 10151
  Gene Symbol: METAP1D
  Gene Name: methionyl aminopeptidase type 1D (mitochondrial)
  Uniprot ID: Q6UB28
  ENSP ID: ENSP00000315152
MAAPSGVHLLVRRGSHRIFSSPLNHIYLHKQSSSQQRRNFFFRRQRDISHSIVLPAAVSSAHPVPKHIKKPDYVTTGIVPDWGDSIEVKNEDQIQGLHQACQLARHVLLLAGKSLKVDMTTEEIDALVHREIISHNAYPSPLGYGGFPKSVCTSVNNVLCHGIPDSRPLQDGDIINIDVTVYYNGYHGDTSETFLVGNVDECGKKLVEVARRCRDEAIAACRAGAPFSVIGNTISHITHQNGFQVCPHFVGHGIGSYFHGHPEIWHHANDSDLPMEEGMAFTIEPIITEGSPEFKVLEDAWTVVSLDNQRSAQFEHTVLITSRGAQILTKLPHEA

SEQ ID NO: 50806 - protein, 900 aa, Homo sapiens
  Payload ID: 10152
  Gene Symbol: MARS
  Gene Name: methionyl-tRNA synthetase
  Uniprot ID: P56192
  ENSP ID: ENSP00000262027
MRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPKGKKKK

SEQ ID NO: 50807 - protein, 140 aa, Homo sapiens
  Payload ID: 10152
  Gene Symbol: MARS
  Gene Name: methionyl-tRNA synthetase
  ENSP ID: ENSP00000439307
MRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGRS

SEQ ID NO: 50808 - protein, 546 aa, Homo sapiens
  Payload ID: 10152
  Gene Symbol: MARS
  Gene Name: methionyl-tRNA synthetase
  Uniprot ID: P56192
  ENSP ID: ENSP00000446168
MRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQP

SEQ ID NO: 50809 - protein, 95 aa, Homo sapiens
  Payload ID: 10152
  Gene Symbol: MARS
  Gene Name: methionyl-tRNA synthetase
  ENSP ID: ENSP00000446729
MRLFVSDGVPGCLPVLAAAGRARGRAEVLISTVGPEDCVVPFLTRPKVPVLQLDSGNYLFSTSAICRYFFLLSGWEQDDLTNQWLEWEATELQRS

SEQ ID NO: 50810 - protein, 110 aa, Homo sapiens
  Payload ID: 10152
  Gene Symbol: MARS
  Gene Name: methionyl-tRNA synthetase
  ENSP ID: ENSP00000447145
MRLFVSDGVPGCLPVLAAAGRARGRAEVLISTVGPEDCVVPFLTRPKVPVLQLDSGNYLFSTSAICRYFFLLSGWEQDDLTNQWLEWEATELQWSKARRGKMFLVQCGEP

SEQ ID NO: 50811 - protein, 114 aa, Homo sapiens
  Payload ID: 10152
  Gene Symbol: MARS
  Gene Name: methionyl-tRNA synthetase
  ENSP ID: ENSP00000447258
MRLFVSDGVPGCLPVLAAAGRARGRAEVLISTVGPEDCVVPFLTRPKVPVLQLDSGNYLFSTSAICRGAECPAQLVPDTEYPGTMSASCRDCTETARCPGSPALPPKAAPAQPR

SEQ ID NO: 50812 - protein, 81 aa, Homo sapiens
  Payload ID: 10152
  Gene Symbol: MARS
  Gene Name: methionyl-tRNA synthetase
  ENSP ID: ENSP00000447335
VNIAALLSVMLQPYMPTVSATIQAQLQLPPPACSILLTNFLCTLPAGHQIGTVSPLFQKLENDQIESLRQRFGGGQKRPST

SEQ ID NO: 50813 - protein, 233 aa, Homo sapiens
  Payload ID: 10152
  Gene Symbol: MARS
  Gene Name: methionyl-tRNA synthetase
  ENSP ID: ENSP00000447914
  MOD_RES (1)..(1): Any amino acid
XRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRF

SEQ ID NO: 50814 - protein, 124 aa, Homo sapiens
  Payload ID: 10152
  Gene Symbol: MARS
  Gene Name: methionyl-tRNA synthetase
  ENSP ID: ENSP00000448378
  MOD_RES (1)..(1): Any amino acid
XNIAALLSVMLQPYMPTVSATIQAQLQLPPPACSILLTNFLCTLPAGHQIGTVSPLFQKLENDQIESLRQRFGGGQVRKLKAVPSLHNSHSITSLISLSSPHPSLFPSFGPAASSLTVFLSCLN

SEQ ID NO: 50815 - protein, 71 aa, Homo sapiens
  Payload ID: 10152
  Gene Symbol: MARS
  Gene Name: methionyl-tRNA synthetase
  ENSP ID: ENSP00000448576
MRLFVSDGVPGCLPVLAAAGRARGRAEVLISTVGPEDCVVPFLTRPKVPVLQLDSGNYLFSTSAICRRQNL

SEQ ID NO: 50816 - protein, 119 aa, Homo sapiens
  Payload ID: 10152
  Gene Symbol: MARS
  Gene Name: methionyl-tRNA synthetase
  ENSP ID: ENSP00000448910
  MOD_RES (1)..(1): Any amino acid
XQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQV

SEQ ID NO: 50817 - protein, 58 aa, Homo sapiens
  Payload ID: 10152
  Gene Symbol: MARS
  Gene Name: methionyl-tRNA synthetase
  ENSP ID: ENSP00000449071
GFVLQDTVEQLRCEHCARFLADRFVEGVCPFCGYEEARGDQCDKCGETLGSKETVGCS

SEQ ID NO: 50818 - protein, 219 aa, Homo sapiens
  Payload ID: 10152
  Gene Symbol: MARS
  Gene Name: methionyl-tRNA synthetase
  ENSP ID: ENSP00000449787
ELLNNLGNFINRAGMFVSKFFGGYVPEMVLTPDDQRLLAHVTLELQHYHQLLEKVRIRDALRSILTISRHGNQYIQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPKGKKKK

SEQ ID NO: 50819 - protein, 60 aa, Homo sapiens
  Payload ID: 10152
  Gene Symbol: MARS
  Gene Name: methionyl-tRNA synthetase
  ENSP ID: ENSP00000450018
MRLFVSDGVPGCLPVLAAAGRARGRAEVLISTVGPEDCTETARCPGSPALPPKAAPAQPR

SEQ ID NO: 50820 - protein, 71 aa, Homo sapiens; identical to SEQ ID NO: 50815
  Payload ID: 10152
  Gene Symbol: MARS
  Gene Name: methionyl-tRNA synthetase
  ENSP ID: ENSP00000485951

SEQ ID NO: 50821 - protein, 60 aa, Homo sapiens; identical to SEQ ID NO: 50819
  Payload ID: 10152
  Gene Symbol: MARS
  Gene Name: methionyl-tRNA synthetase
  ENSP ID: ENSP00000486356

SEQ ID NO: 50822 - protein, 95 aa, Homo sapiens; identical to SEQ ID NO: 50809
  Payload ID: 10152
  Gene Symbol: MARS
  Gene Name: methionyl-tRNA synthetase
  ENSP ID: ENSP00000486738

SEQ ID NO: 50823 - protein, 593 aa, Homo sapiens
  Payload ID: 10153
  Gene Symbol: MARS2
  Gene Name: methionyl-tRNA synthetase 2, mitochondrial
  Uniprot ID: Q96GW9
  ENSP ID: ENSP00000282276
MLRTSVLRLLGRTGASRLSLLEDFGPRYYSSGSLSAGDDACDVRAYFTTPIFYVNAAPHIGHLYSALLADALCRHRRLRGPSTAATRFSTGTDEHGLKIQQAAATAGLAPTELCDRVSEQFQQLFQEAGISCTDFIRTTEARHRVAVQHFWGVLKSRGLLYKGVYEGWYCASDECFLPEAKVTQQPGPSGDSFPVSLESGHPVSWTKEENYIFRLSQFRKPLQRWLRGNPQAITPEPFHHVVLQWLDEELPDLSVSRRSSHLHWGIPVPGDDSQTIYVWLDALVNYLTVIGYPNAEFKSWWPATSHIIGKDILKFHAIYWPAFLLGAGMSPPQRICVHSHWTVCGQKMSKSLGNVVDPRTCLNRYTVDGFRYFLLRQGVPNWDCDYYDEKVVKLLNSELADALGGLLNRCTAKRINPSETYPAFCTTCFPSEPGLVGPSVRAQAEDYALVSAVATLPKQVADHYDNFRIYKALEAVSSCVRQTNGFVQRHAPWKLNWESPVDAPWLGTVLHVALECLRVFGTLLQPVTPSLADKLLSRLGVSASERSLGELYFLPRFYGHPCPFEGRRLGPETGLLFPRLDQSRTWLVKAHRT

SEQ ID NO: 50824 - protein, 486 aa, Homo sapiens
  Payload ID: 10154
  Gene Symbol: MECP2
  Gene Name: methyl CpG binding protein 2
  Uniprot ID: P51608
  ENSP ID: ENSP00000301948
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTERVS

SEQ ID NO: 50825 - protein, 37 aa, Homo sapiens
  Payload ID: 10154
  Gene Symbol: MECP2
  Gene Name: methyl CpG binding protein 2
  ENSP ID: ENSP00000358973
MVAGMLGLSCKMGFRSVLKPVVPGPRREKQLPGEVSS

SEQ ID NO: 50826 - protein, 184 aa, Homo sapiens
  Payload ID: 10154
  Gene Symbol: MECP2
  Gene Name: methyl CpG binding protein 2
  ENSP ID: ENSP00000384865
MAAAAAAAPSGGGGGGEEERLEEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKLQELAEAGDAPKGAAPRDPRRPRQRVCR

SEQ ID NO: 50827 - protein, 498 aa, Homo sapiens [sequence omitted]

SEQ ID NO: 50828 - protein, 49 aa, Homo sapiens
  Payload ID: 10154
  Gene Symbol: MECP2
  Gene Name: methyl CpG binding protein 2
  ENSP ID: ENSP00000416267
MVAGMLGLREEKSEDQDLQGLKDKPLKFKKVKKDKKEEKEGKHEPVQPS

SEQ ID NO: 50829 - protein, 168 aa, Homo sapiens
  Payload ID: 10154
  Gene Symbol: MECP2
  Gene Name: methyl CpG binding protein 2
  ENSP ID: ENSP00000479736
MLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGREPLPARAETT

SEQ ID NO: 50830 - protein, 509 aa, Homo sapiens
  Payload ID: 10154
  Gene Symbol: MECP2
  Gene Name: methyl CpG binding protein 2
  ENSP ID: ENSP00000480973
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTELADFTRSGLQSKPTRIKAAVVSSPYG

SEQ ID NO: 50831 - protein, 324 aa, Homo sapiens
  Payload ID: 10154
  Gene Symbol: MECP2
  Gene Name: methyl CpG binding protein 2
  ENSP ID: ENSP00000484470
MLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKEFYPICAGDRTPHQEAQDPGDGQHRGQGSGEAPAGVHPR

SEQ ID NO: 50832 - protein, 41 aa, Homo sapiens
  Payload ID: 10154
  Gene Symbol: MECP2
  Gene Name: methyl CpG binding protein 2
  ENSP ID: ENSP00000486089
MVAGMLGLREEKSEDQDLQGLKDKPLKFKKVKKDKKEEKEG

SEQ ID NO: 50833 - protein, 172 aa, Homo sapiens
  Payload ID: 10154
  Gene Symbol: MECP2
  Gene Name: methyl CpG binding protein 2
  ENSP ID: ENSP00000486978
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKLQELAEAGDAPKGAAPRDPRRPRQRVCR

SEQ ID NO: 50834 - protein, 580 aa, Homo sapiens
  Payload ID: 10155
  Gene Symbol: MBD4
  Gene Name: methyl-CpG binding domain 4 DNA glycosylase
  Uniprot ID: O95243
  ENSP ID: ENSP00000249910
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFQEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 50835 - protein, 262 aa, Homo sapiens
  Payload ID: 10155
  Gene Symbol: MBD4
  Gene Name: methyl-CpG binding domain 4 DNA glycosylase
  Uniprot ID: O95243
  ENSP ID: ENSP00000376959
MGTTGLESLSLGDRGAAPTVTSSERLVPDPPNDLRKEDVAMELERVGEDEEQMMIKRSSECNPLLQEPIASAQFGATAGTECQDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 50836 - protein, 574 aa, Homo sapiens
  Payload ID: 10155
  Gene Symbol: MBD4
  Gene Name: methyl-CpG binding domain 4 DNA glycosylase
  Uniprot ID: O95243
  ENSP ID: ENSP00000394080
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 50837 - protein, 572 aa, Homo sapiens
  Payload ID: 10155
  Gene Symbol: MBD4
  Gene Name: methyl-CpG binding domain 4 DNA glycosylase
  Uniprot ID: O95243
  ENSP ID: ENSP00000422327
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFQEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVRLTPIHNSAHLVSEAK

SEQ ID NO: 50838 - protein, 52 aa, Homo sapiens
  Payload ID: 10155
  Gene Symbol: MBD4
  Gene Name: methyl-CpG binding domain 4 DNA glycosylase
  ENSP ID: ENSP00000422690
MGTTGLESLSLGDRGAAPTVTSSERLVPDPPNDLRQNGNTCALEVSGEVSFS

SEQ ID NO: 50839 - protein, 540 aa, Homo sapiens
  Payload ID: 10155
  Gene Symbol: MBD4
  Gene Name: methyl-CpG binding domain 4 DNA glycosylase
  Uniprot ID: O95243
  ENSP ID: ENSP00000424873
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFQEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGAP

SEQ ID NO: 50840 - protein, 605 aa, Homo sapiens
  Payload ID: 10156
  Gene Symbol: MBD1
  Gene Name: methyl-CpG binding domain protein 1
  Uniprot ID: Q9UIS9
  ENSP ID: ENSP00000269468
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 50841 - protein, 556 aa, Homo sapiens
  Payload ID: 10156
  Gene Symbol: MBD1
  Gene Name: methyl-CpG binding domain protein 1
  Uniprot ID: Q9UIS9
  ENSP ID: ENSP00000269469
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 50842 - protein, 586 aa, Homo sapiens
  Payload ID: 10156
  Gene Symbol: MBD1
  Gene Name: methyl-CpG binding domain protein 1
  Uniprot ID: Q9UIS9
  ENSP ID: ENSP00000269471
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPSLQGRHSGREDGCKVWETEDTVEPTSTSWNPRGWPGTHVSLSPPPASMMWVSCRRSWCPSSQS

SEQ ID NO: 50843 - protein, 549 aa, Homo sapiens
  Payload ID: 10156
  Gene Symbol: MBD1
  Gene Name: methyl-CpG binding domain protein 1
  Uniprot ID: Q9UIS9
  ENSP ID: ENSP00000285102
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 50844 - protein, 550 aa, Homo sapiens
  Payload ID: 10156
  Gene Symbol: MBD1
  Gene Name: methyl-CpG binding domain protein 1
  Uniprot ID: Q9UIS9
  ENSP ID: ENSP00000339546
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVEPTTQPQYSGNFDNDLYEIYLIDI

SEQ ID NO: 50845 - protein, 605 aa, Homo sapiens; identical to SEQ ID NO: 50840
  Payload ID: 10156
  Gene Symbol: MBD1
  Gene Name: methyl-CpG binding domain protein 1
  Uniprot ID: Q9UIS9
  ENSP ID: ENSP00000372407

SEQ ID NO: 50846 - protein, 503 aa, Homo sapiens
  Payload ID: 10156
  Gene Symbol: MBD1
  Gene Name: methyl-CpG binding domain protein 1
  Uniprot ID: Q9UIS9
  ENSP ID: ENSP00000381502
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPRSKDLKKPGARKQ

SEQ ID NO: 50847 - protein, 549 aa, Homo sapiens; identical to SEQ ID NO: 50843
  Payload ID: 10156
  Gene Symbol: MBD1
  Gene Name: methyl-CpG binding domain protein 1
  Uniprot ID: Q9UIS9
  ENSP ID: ENSP00000381506

SEQ ID NO: 50848 - protein, 566 aa, Homo sapiens
  Payload ID: 10156
  Gene Symbol: MBD1
  Gene Name: methyl-CpG binding domain protein 1
  ENSP ID: ENSP00000381508
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRHLAHRLRRRHQRCQRRTPLAVAPPTGKHARRKGGCDSKMAARRRPGAQPLPPPPPSQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEITEIFSLGGTRFRDTAVWLPRSKDLKKPGARKQ

SEQ ID NO: 50849 - protein, 630 aa, Homo sapiens
  Payload ID: 10156
  Gene Symbol: MBD1
  Gene Name: methyl-CpG binding domain protein 1
  Uniprot ID: Q9UIS9
  ENSP ID: ENSP00000405268
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRHLAHRLRRRHQRCQRRTPLAVAPPTGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 50850 - protein, 44 aa, Homo sapiens
  Payload ID: 10156
  Gene Symbol: MBD1
  Gene Name: methyl-CpG binding domain protein 1
  ENSP ID: ENSP00000464823
MAEDWLDCPALGPGWKRREVFRKSGATCGRSDTYYQRRQDPKQS

SEQ ID NO: 50851 - protein, 536 aa, Homo sapiens
  Payload ID: 10156
  Gene Symbol: MBD1
  Gene Name: methyl-CpG binding domain protein 1
  Uniprot ID: Q9UIS9
  ENSP ID: ENSP00000465923
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPRSKDLKKPGARKQ

SEQ ID NO: 50852 - protein, 567 aa, Homo sapiens
  Payload ID: 10156
  Gene Symbol: MBD1
  Gene Name: methyl-CpG binding domain protein 1
  Uniprot ID: Q9UIS9
  ENSP ID: ENSP00000466092
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRYYHLALDWKCNCGYHLCCRSVLVP

SEQ ID NO: 50853 - protein, 256 aa, Homo sapiens
  Payload ID: 10156
  Gene Symbol: MBD1
  Gene Name: methyl-CpG binding domain protein 1
  ENSP ID: ENSP00000466429
  MOD_RES (1)..(1): Any amino acid
XENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPKRLLPSVWSESEDGAGSPPPYRRRKRPSSARRHHLGPTLKPTLATRTAQPDHTQAPTKQEAGGGFVLPPPGTDLVFLREGASSPV

SEQ ID NO: 50854 - protein, 240 aa, Homo sapiens
  Payload ID: 10156
  Gene Symbol: MBD1
  Gene Name: methyl-CpG binding domain protein 1
  ENSP ID: ENSP00000466806
SQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 50855 - protein, 605 aa, Homo sapiens; identical to SEQ ID NO: 50840
  Payload ID: 10156
  Gene Symbol: MBD1
  Gene Name: methyl-CpG binding domain protein 1
  Uniprot ID: Q9UIS9
  ENSP ID: ENSP00000467017

SEQ ID NO: 50856 - protein, 416 aa, Homo sapiens
  Payload ID: 10156
  Gene Symbol: MBD1
  Gene Name: methyl-CpG binding domain protein 1
  ENSP ID: ENSP00000467606
  MOD_RES (1)..(1): Any amino acid
XHPVAVASKKRKKPSRPAKTRKRQVGPQSGEVRKEAPRDETKADTDTAPASFPAPGCCENCGISFSGDGTQRQRLKTLCKDCRAQRIAFNREQRMFKSRGCGVCRGCQTQEDCGHCPICLRPPRPGLRRQWKCVQRRCLRHLAHRLRRRHQRCQRRTPLAVAPPTGKHARRKGGCDSKMAARRRPGAQPLPPPPPSQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPRYYHLALDWKCNCGYHLCCRSVLVP

SEQ ID NO: 50857 - protein, 586 aa, Homo sapiens; identical to SEQ ID NO: 50842
  Payload ID: 10156
  Gene Symbol: MBD1
  Gene Name: methyl-CpG binding domain protein 1
  Uniprot ID: Q9UIS9
  ENSP ID: ENSP00000467763

SEQ ID NO: 50858 - protein, 535 aa, Homo sapiens
  Payload ID: 10156
  Gene Symbol: MBD1
  Gene Name: methyl-CpG binding domain protein 1
  Uniprot ID: Q9UIS9
  ENSP ID: ENSP00000468042
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPRAGTREGKMDVKCGRPRTQWSPRARAGTHEDGLEPMSVSHHLQLR

SEQ ID NO: 50859 - protein, 630 aa, Homo sapiens; identical to SEQ ID NO: 50849
  Payload ID: 10156
  Gene Symbol: MBD1
  Gene Name: methyl-CpG binding domain protein 1
  Uniprot ID: Q9UIS9
  ENSP ID: ENSP00000468430

SEQ ID NO: 50860 - protein, 655 aa, Homo sapiens
  Payload ID: 10156
  Gene Symbol: MBD1
  Gene Name: methyl-CpG binding domain protein 1
  Uniprot ID: Q9UIS9
  ENSP ID: ENSP00000468785
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPSLQGRHSGREDGCKVWETEDTVEPTSTSWNPRGWPGTHVSLSPPPASMMWVSCRRSWCPSSQS

SEQ ID NO: 50861 - protein, 411 aa, Homo sapiens
  Payload ID: 10157
  Gene Symbol: MBD2
  Gene Name: methyl-CpG binding domain protein 2
  Uniprot ID: Q9UBB5
  ENSP ID: ENSP00000256429
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKGKPDLNTTLPIRQTASIFKQPVTKVTNHPSNKVKSDPQRMNEQPRQLFWEKRLQGLSASDVTEQIIKTMELPKGLQGVGPGSNDETLLSAVASALHTSSAPITGQVSAAVEKNPAVWLNTSQPLCKAFIVTDEDIRKQEERVQQVRKKLEEALMADILSRAADTEEMDIEMDSGDEA

SEQ ID NO: 50862 - protein, 241 aa, Homo sapiens
  Payload ID: 10157
  Gene Symbol: MBD2
  Gene Name: methyl-CpG binding domain protein 2
  ENSP ID: ENSP00000381435
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKFVCTFLL

SEQ ID NO: 50863 - protein, 72 aa, Homo sapiens
  Payload ID: 10157
  Gene Symbol: MBD2
  Gene Name: methyl-CpG binding domain protein 2
  ENSP ID: ENSP00000462393
NDPLNQNKGKPDLNTTLPIRQTASIFKQPVTKVTNHPSNKVKSDPQRMNEQPRQVSQENRRYLEPHWISILL

SEQ ID NO: 50864 - protein, 302 aa, Homo sapiens
  Payload ID: 10157
  Gene Symbol: MBD2
  Gene Name: methyl-CpG binding domain protein 2
  Uniprot ID: Q9UBB5
  ENSP ID: ENSP00000464554
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKLRWNTHRPAPWHALSRLCLLIRCLLCLECAYPLPLHLVNSYSSKTQLHCLHLWEACPAYSRQNQSFPP

SEQ ID NO: 50865 - protein, 259 aa, Homo sapiens
  Payload ID: 10158
  Gene Symbol: MBD3
  Gene Name: methyl-CpG binding domain protein 3
  Uniprot ID: O95983
  ENSP ID: ENSP00000156825
MERKSPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 50866 - protein, 291 aa, Homo sapiens
  Payload ID: 10158
  Gene Symbol: MBD3
  Gene Name: methyl-CpG binding domain protein 3
  Uniprot ID: O95983
  ENSP ID: ENSP00000412302
MERKRWECPALPQGWEREEVPRRSGLSAGHRDVFYYSPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 50867 - protein, 235 aa, Homo sapiens
  Payload ID: 10158
  Gene Symbol: MBD3
  Gene Name: methyl-CpG binding domain protein 3
  ENSP ID: ENSP00000464718
MDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 50868 - protein, 185 aa, Homo sapiens
  Payload ID: 10158
  Gene Symbol: MBD3
  Gene Name: methyl-CpG binding domain protein 3
  ENSP ID: ENSP00000466670
MDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDISRKSWCSRCGSGWRRR

SEQ ID NO: 50869 - protein, 130 aa, Homo sapiens
  Payload ID: 10158
  Gene Symbol: MBD3
  Gene Name: methyl-CpG binding domain protein 3
  ENSP ID: ENSP00000477547
MDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALH

SEQ ID NO: 50870 - protein, 41 aa, Homo sapiens
  Payload ID: 10158
  Gene Symbol: MBD3
  Gene Name: methyl-CpG binding domain protein 3
  ENSP ID: ENSP00000479427
  MOD_RES (1)..(1): Any amino acid
XDPQKAVDQPRQSLALSPRLECSGRILTHYNLCLLVSTGFK

SEQ ID NO: 50871 - protein, 34 aa, Homo sapiens
  Payload ID: 10158
  Gene Symbol: MBD3
  Gene Name: methyl-CpG binding domain protein 3
  ENSP ID: ENSP00000482276
MDLSTFDFRTGKMLMSKMNKSRQRVRYDSSNQVK

SEQ ID NO: 50872 - protein, 147 aa, Homo sapiens
  Payload ID: 10158
  Gene Symbol: MBD3
  Gene Name: methyl-CpG binding domain protein 3
  ENSP ID: ENSP00000484202
MDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKN

SEQ ID NO: 50873 - protein, 194 aa, Homo sapiens
  Payload ID: 10159
  Gene Symbol: MBD3L1
  Gene Name: methyl-CpG binding domain protein 3-like 1
  Uniprot ID: Q8WWY6
  ENSP ID: ENSP00000304198
MAKSSQRKQRDCVNQCKSKPGLSTSIPLRMSSYTFKRPVTRITPHPGNEVRYHQWEESLEKPQQVCWQRRLQGLQAYSSAGELSSTLDLANTLQKLVPSYTGGSLLEDLASGLEHSCPMPHLACSSDAVEIIPAEGVGISQLLCKQFLVTEEDIRKQEGKVKTVRERLAIALIADGLANEAEKVRDQEGRPEKR

SEQ ID NO: 50874 - protein, 194 aa, Homo sapiens; identical to SEQ ID NO: 50873
  Payload ID: 10159
  Gene Symbol: MBD3L1
  Gene Name: methyl-CpG binding domain protein 3-like 1
  Uniprot ID: Q8WWY6
  ENSP ID: ENSP00000471575

SEQ ID NO: 50875 - protein, 208 aa, Homo sapiens
  Payload ID: 10160
  Gene Symbol: MBD3L2
  Gene Name: methyl-CpG binding domain protein 3-like 2
  Uniprot ID: Q8NHZ7
  ENSP ID: ENSP00000370800
MGEPAFTSFPSLPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRSPLEPTPGRFPAVAGGPTPGMGCQLPPPLSGQLVTPADIRRQARRVKKARERLAKALQADRLARRAEMLTGG

SEQ ID NO: 50876 - protein, 204 aa, Homo sapiens
  Payload ID: 10160
  Gene Symbol: MBD3L2
  Gene Name: methyl-CpG binding domain protein 3-like 2
  ENSP ID: ENSP00000480390
MGEPAFTSFPSLPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRSPLEPTPGRFPAVAGGPTPGMGCQLPPPLSGQLVTPADIRRQARRVKKARERLAKALQADRLARRAEM

SEQ ID NO: 50877 - protein, 208 aa, Homo sapiens
  Payload ID: 10161
  Gene Symbol: MBD3L3
  Gene Name: methyl-CpG binding domain protein 3-like 3
  Uniprot ID: A6NE82
  ENSP ID: ENSP00000333183
MGEPAFTSFPSPPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRSPLEPTPGRFPAVAGGPTPGMGCQLPPPLSGQLVTPADIRRQARRVKKARERLAKALQADRLARQAEMLTCR

SEQ ID NO: 50878 - protein, 204 aa, Homo sapiens
  Payload ID: 10161
  Gene Symbol: MBD3L3
  Gene Name: methyl-CpG binding domain protein 3-like 3
  ENSP ID: ENSP00000478905
MGEPAFTSFPSPPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRSPLEPTPGRFPAVAGGPTPGMGCQLPPPLSGQLVTPADIRRQARRVKKARERLAKALQADRLARQAEM

SEQ ID NO: 50879 - protein, 208 aa, Homo sapiens
  Payload ID: 10162
  Gene Symbol: MBD3L4
  Gene Name: methyl-CpG binding domain protein 3-like 4
  Uniprot ID: A6NDZ8
  ENSP ID: ENSP00000370801
MGEPAFTSFPSPPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRIPLEPTPGRFPAVAGGPTPGMGCQLPPPLSGQLVTPADIRRQARRVKKARERLAKALQADRLARQAEMLTCR

SEQ ID NO: 50880 - protein, 204 aa, Homo sapiens
  Payload ID: 10162
  Gene Symbol: MBD3L4
  Gene Name: methyl-CpG binding domain protein 3-like 4
  ENSP ID: ENSP00000484740
MGEPAFTSFPSPPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRIPLEPTPGRFPAVAGGPTPGMGCQLPPPLSGQLVTPADIRRQARRVKKARERLAKALQADRLARQAEM

SEQ ID NO: 50881 - protein, 208 aa, Homo sapiens
  Payload ID: 10163
  Gene Symbol: MBD3L5
  Gene Name: methyl-CpG binding domain protein 3-like 5
  Uniprot ID: A6NJ08
  ENSP ID: ENSP00000331435
MGEPAFTSFPSPPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTAGESLDRAGAERVRIPLEPTPGRFPAVAGGPTPGMGCQLPPPLSGQLVTPADIRRQARRVKKARERLAKALQADRLARQAEMLTGG

SEQ ID NO: 50882 - protein, 204 aa, Homo sapiens; identical to SEQ ID NO: 50880
  Payload ID: 10163
  Gene Symbol: MBD3L5
  Gene Name: methyl-CpG binding domain protein 3-like 5
  ENSP ID: ENSP00000477634

SEQ ID NO: 50883 - protein, 1727 aa, Homo sapiens
  Payload ID: 10164
  Gene Symbol: MBD5
  Gene Name: methyl-CpG binding domain protein 5
  ENSP ID: ENSP00000384672
MNGGKECDGGDKEGGLPAIQVPVGWQRRVDQNGVLYVSPSGSLLSCLEQVKTYLLTDGTCKCGLECPLILPKVFNFDPGAAVKQRTAEDVKADEDVTKLCIHKRKIIAVATLHKSMEAPHPSLVLTSPGGGTNATPVVPSRAATPRSVRNKSHEGITNSVMPECKNPFKLMIGSSNAMGRLYVQELPGSQQQELHPVYPRQRLGSSEHGQKSPFRGSHGGLPSPASSGSQIYGDGSISPRTDPLGSPDVFTRSNPGFHGAPNSSPIHLNRTPLSPPSVMLHGSPVQSSCAMAGRTNIPLSPTLTTKSPVMKKPMCNFSTNMEIPRAMFHHKPPQGPPPPPPPSCALQKKPLTSEKDPLGILDPIPSKPVNQNPVIINPTSFHSNVHSQVPMMNVSMPPAVVPLPSNLPLPTVKPGHMNHGSHVQRVQHSASTSLSPSPVTSPVHMMGTGIGRIEASPQRSRSSSTSSDHGNFMMPPVGPQATSSGIKVPPRSPRSTIGSPRPSMPSSPSTKSDGHHQYKDIPNPLIAGISNVLNTPSSAAFPTASAGSSSVKSQPGLLGMPLNQILNQHNAASFPASSLLSAAAKAQLANQNKLAGNNSSSSSNSGAVAGSGNTEGHSTLNTMFPPTANMLLPTGEGQSGRAALRDKLMSQQKDALRKRKQPPTTVLSLLRQSQMDSSAVPKPGPDLLRKQGQGSFPISSMSQLLQSMSCQSSHLSSNSTPGCGASNTALPCSANQLHFTDPSMNSSVLQNIPLRGEAVHCHNANTNFVHSNSPVPNHHLAGLINQIQASGNCGMLSQSGMALGNSLHPNPPQSRISTSSTPVIPNSIVSSYNQTSSEAGGSGPSSSIAIAGTNHPAITKTTSVLQDGVIVTTAAGNPLQSQLPIGSDFPFVGQEHALHFPSNSTSNNHLPHPLNPSLLSSLPISLPVNQQHLLNQNLLNILQPSAGEGKSEINLHPLGFLNPNVNAALAFLSSDMDGQVLQPVHFQLLAALLQNQAQAAAMLPLPSFNLTISDLLQQQNTPLPSLTQMTAPPDHLPSNQSDNSRAETLLTSPLGNPLPSFAGSDTTFNPLFLPAVNGASGLMTLNPQLLGGVLNSASANTANHPEVSIATSSQATTTTTTTSSAVAALTVSTLGGTAVVSMAETLLNISNNAGNTPGPAKLNSNSVVPQLLNPLLGTGLLGDMSSINNTLSNHQLTHLQSLLNNNQMFPPNQQQQQLLQGYQNLQAFQGQSTIPCPANNNPMACLFQNFQVRMQEDAALLNKRISTQPGLTALPENPNTTLPPFQDTPCELQPRIDPSLGQQVKDGLVVGGPGDASVDAIYKAVVDAASKGMQVVITTAVNSTTQISPIPALSAMSAFTASIGDPLNLSSAVSAVIHGRNMGGVDHDGRLRNSRGARLPKNLDHGKNVNEGDGFEYFKSASCHTSKKQWDGEQSPRGERNRWKYEEFLDHPGHIHSSPCHERPNNVSTLPFLPGEQHPILLPPRNCPGDKILEENFRYNNYKRTMMSFKERLENTVERCAHINGNRPRQSRGFGELLSTAKQDLVLEEQSPSSSNSLENSLVKDYIHYNGDFNAKSVNGCVPSPSDAKSISSEDDLRNPDSPSSNELIHYRPRTFNVGDLVWGQIKGLTSWPGKLVREDDVHNSCQQSPEEGKVEPEKLKTLTEGLEAYSRVRKRNRKSGKLNNHLEAAIHEAMSELDKMSGTVHQIPQGDRQMRPPKPKRRKISR

SEQ ID NO: 50884 - protein, 1494 aa, Homo sapiens
  Payload ID: 10164
  Gene Symbol: MBD5
  Gene Name: methyl-CpG binding domain protein 5
  Uniprot ID: Q9P267
  ENSP ID: ENSP00000386049
MNGGKECDGGDKEGGLPAIQVPVGWQRRVDQNGVLYVSPSGSLLSCLEQVKTYLLTDGTCKCGLECPLILPKVFNFDPGAAVKQRTAEDVKADEDVTKLCIHKRKIIAVATLHKSMEAPHPSLVLTSPGGGTNATPVVPSRAATPRSVRNKSHEGITNSVMPECKNPFKLMIGSSNAMGRLYVQELPGSQQQELHPVYPRQRLGSSEHGQKSPFRGSHGGLPSPASSGSQIYGDGSISPRTDPLGSPDVFTRSNPGFHGAPNSSPIHLNRTPLSPPSVMLHGSPVQSSCAMAGRTNIPLSPTLTTKSPVMKKPMCNFSTNMEIPRAMFHHKPPQGPPPPPPPSCALQKKPLTSEKDPLGILDPIPSKPVNQNPVIINPTSFHSNVHSQVPMMNVSMPPAVVPLPSNLPLPTVKPGHMNHGSHVQRVQHSASTSLSPSPVTSPVHMMGTGIGRIEASPQRSRSSSTSSDHGNFMMPPVGPQATSSGIKVPPRSPRSTIGSPRPSMPSSPSTKSDGHHQYKDIPNPLIAGISNVLNTPSSAAFPTASAGSSSVKSQPGLLGMPLNQILNQHNAASFPASSLLSAAAKAQLANQNKLAGNNSSSSSNSGAVAGSGNTEGHSTLNTMFPPTANMLLPTGEGQSGRAALRDKLMSQQKDALRKRKQPPTTVLSLLRQSQMDSSAVPKPGPDLLRKQGQGSFPISSMSQLLQSMSCQSSHLSSNSTPGCGASNTALPCSANQLHFTDPSMNSSVLQNIPLRGEAVHCHNANTNFVHSNSPVPNHHLAGLINQIQASGNCGMLSQSGMALGNSLHPNPPQSRISTSSTPVIPNSIVSSYNQTSSEAGGSGPSSSIAIAGTNHPAITKTTSVLQDGVIVTTAAGNPLQSQLPIGSDFPFVGQEHALHFPSNSTSNNHLPHPLNPSLLSSLPISLPVNQQHLLNQNLLNILQPSAGEGDMSSINNTLSNHQLTHLQSLLNNNQMFPPNQQQQQLLQGYQNLQAFQGQSTIPCPANNNPMACLFQNFQVRMQEDAALLNKRISTQPGLTALPENPNTTLPPFQDTPCELQPRIDPSLGQQVKDGLVVGGPGDASVDAIYKAVVDAASKGMQVVITTAVNSTTQISPIPALSAMSAFTASIGDPLNLSSAVSAVIHGRNMGGVDHDGRLRNSRGARLPKNLDHGKNVNEGDGFEYFKSASCHTSKKQWDGEQSPRGERNRWKYEEFLDHPGHIHSSPCHERPNNVSTLPFLPGEQHPILLPPRNCPGDKILEENFRYNNYKRTMMSFKERLENTVERCAHINGNRPRQSRGFGELLSTAKQDLVLEEQSPSSSNSLENSLVKDYIHYNGDFNAKSVNGCVPSPSDAKSISSEDDLRNPDSPSSNELIHYRPRTFNVGDLVWGQIKGLTSWPGKLVREDDVHNSCQQSPEEGKVEPEKLKTLTEGLEAYSRVRKRNRKSGKLNNHLEAAIHEAMSELDKMSGTVHQIPQGDRQMRPPKPKRRKISR

SEQ ID NO: 50885 - protein, 1064 aa, Homo sapiens
  Payload ID: 10164
  Gene Symbol: MBD5
  Gene Name: methyl-CpG binding domain protein 5
  ENSP ID: ENSP00000393168
  MOD_RES (1)..(1): Any amino acid
XNSSPIHLNRTPLSPPSVMLHGSPVQSSCAMAGRTNIPLSPTLTTKSPVMKKPMCNFSTNMEIPRAMFHHKPPQGPPPPPPPSCALQKKPLTSEKDPLGILDPIPSKPVNQNPVIINPTSFHSNVHSQVPMMNVSMPPAVVPLPSNLPLPTVKPGHMNHGSHVQRVQHSASTSLSPSPVTSPVHMMGTGIGRIEASPQRSRSSSTSSDHGNFMMPPVGPQATSSGIKVPPRSPRSTIGSPRPSMPSSPSTKSDGHHQYKDIPNPLIAGISNVLNTPSSAAFPTASAGSSSVKSQPGLLGMPLNQILNQHNAASFPASSLLSAAAKAQLANQNKLAGNNSSSSSNSGAVAGSGNTEGHSTLNTMFPPTANMLLPTGEGQSGRAALRDKLMSQQKDALRKRKQPPTTVLSLLRQSQMDSSAVPKPGPDLLRKQGQGSFPISSMSQLLQSMSCQSSHLSSNSTPGCGASNTALPCSANQLHFTDPSMNSSVLQNIPLRGEAVHCHNANTNFVHSNSPVPNHHLAGLINQIQASGNCGMLSQSGMALGNSLHPNPPQSRISTSSTPVIPNSIVSSYNQTSSEAGGSGPSSSIAIAGTNHPAITKTTSVLQDGVIVTTAAGNPLQSQLPIGSDFPFVGQEHALHFPSNSTSNNHLPHPLNPSLLSSLPISLPVNQQHLLNQNLLNILQPSAGEGKSEINLHPLGFLNPNVNAALAFLSSDMDGQVLQPVHFQLLAALLQNQAQAAAMLPLPSFNLTISDLLQQQNTPLPSLTQMTAPPDHLPSNQSDNSRAETLLTSPLGNPLPSFAGSDTTFNPLFLPAVNGASGLMTLNPQLLGGVLNSASANTANHPEVSIATSSQATTTTTTTSSAVAALTVSTLGGTAVVSMAETLLNISNNAGNTPGPAKLNSNSVVPQLLNPLLGTGLLGDMSSINNTLSNHQLTHLQSLLNNNQMFPPNQQQQQLLQGYQNLQAFQGQSTIPCPANNNPMACLFQNFQVEPEKLKTLTEGLEAYSRVRKRNRKSGKLNNHLEAAIHEAMSELDKMSGTVHQIPQGDRQMRPPKPKRRKISR

SEQ ID NO: 50886 - protein, 77 aa, Homo sapiens
  Payload ID: 10164
  Gene Symbol: MBD5
  Gene Name: methyl-CpG binding domain protein 5
  ENSP ID: ENSP00000485889
  MOD_RES (1)..(1): Any amino acid
XSPSSNELIHYRPRTFNVGDLVWGQIKGLTSWPGKLVREDDVHNSCQQSPEEGKVHQIPQGDRQMRPPKPKRRKISR

SEQ ID NO: 50887 - protein, 113 aa, Homo sapiens
  Payload ID: 10164
  Gene Symbol: MBD5
  Gene Name: methyl-CpG binding domain protein 5
  ENSP ID: ENSP00000486209
PSSSNSLENSLVKDYIHYNGDFNAKSVNGCVPSPSDAKSISSEDDLRNPDSPSSNELIHYRPRTFNVGDLVWGQIKGLTSWPGKLVREDDVHNSCQQSPEEGKVYQSLSIVKY

SEQ ID NO: 50888 - protein, 851 aa, Homo sapiens
  Payload ID: 10164
  Gene Symbol: MBD5
  Gene Name: methyl-CpG binding domain protein 5
  Uniprot ID: Q9P267
  ENSP ID: ENSP00000486370
MNGGKECDGGDKEGGLPAIQVPVGWQRRVDQNGVLYVSPSGSLLSCLEQVKTYLLTDGTCKCGLECPLILPKVFNFDPGAAVKQRTAEDVKADEDVTKLCIHKRKIIAVATLHKSMEAPHPSLVLTSPGGGTNATPVVPSRAATPRSVRNKSHEGITNSVMPECKNPFKLMIGSSNAMGRLYVQELPGSQQQELHPVYPRQRLGSSEHGQKSPFRGSHGGLPSPASSGSQIYGDGSISPRTDPLGSPDVFTRSNPGFHGAPNSSPIHLNRTPLSPPSVMLHGSPVQSSCAMAGRTNIPLSPTLTTKSPVMKKPMCNFSTNMEIPRAMFHHKPPQGPPPPPPPSCALQKKPLTSEKDPLGILDPIPSKPVNQNPVIINPTSFHSNVHSQVPMMNVSMPPAVVPLPSNLPLPTVKPGHMNHGSHVQRVQHSASTSLSPSPVTSPVHMMGTGIGRIEASPQRSRSSSTSSDHGNFMMPPVGPQATSSGIKVPPRSPRSTIGSPRPSMPSSPSTKSDGHHQYKDIPNPLIAGISNVLNTPSSAAFPTASAGSSSVKSQPGLLGMPLNQILNQHNAASFPASSLLSAAAKAQLANQNKLAGNNSSSSSNSGAVAGSGNTEGHSTLNTMFPPTANMLLPTGEGQSGRAALRDKLMSQQKDALRKRKQPPTTVLSLLRQSQMDSSAVPKPGPDLLRKQGQGSFPISSMSQLLQSMSCQSSHLSSNSTPGCGASNTALPCSANQLHFTDPSMNSSVLQNIPLRGEAVHCHNANTNFVHSNSPVPNHHLAGLINQIQASGNCGMLSQSGMALGNSLHPNPPQSRISTSSTPVIPNSIVSSYNQTSSEAGMVLLEKSTQRY

SEQ ID NO: 50889 - protein, 1086 aa, Homo sapiens
  Payload ID: 10164
  Gene Symbol: MBD5
  Gene Name: methyl-CpG binding domain protein 5
  ENSP ID: ENSP00000487089
MNGGKECDGGDKEGGLPAIQVPVGWQRRVDQNGVLYVSPSGSLLSCLEQVKTYLLTDGTCKCGLECPLILPKVFNFDPGAAVKQRTAEDVKADEDVTKLCIHKRKIIAVATLHKSMEAPHPSLVLTSPGGGTNATPVVPSRAATPRSVRNKSHEGITNSVMPECKNPFKLMIGSSNAMGRLYVQELPGSQQQELHPVYPRQRLGSSEHGQKSPFRGSHGGLPSPASSGSQIYGDGSISPRTDPLGSPDVFTRSNPGFHGAPNSSPIHLNRTPLSPPSVMLHGSPVQSSCAMAGRTNIPLSPTLTTKSPVMKKPMCNFSTNMEIPRAMFHHKPPQGPPPPPPPSCALQKKPLTSEKDPLGILDPIPSKPVNQNPVIINPTSFHSNVHSQVPMMNVSMPPAVVPLPSNLPLPTVKPGHMNHGSHVQRVQHSASTSLSPSPVTSPVHMMGTGIGRIEASPQRSRSSSTSSDHGNFMMPPVGPQATSSGIKVPPRSPRSTIGSPRPSMPSSPSTKSDGHHQYKDIPNPLIAGISNVLNTPSSAAFPTASAGSSSVKSQPGLLGMPLNQILNQHNAASFPASSLLSAAAKAQLANQNKLAGNNSSSSSNSGAVAGSGNTEGHSTLNTMFPPTANMLLPTGEGQSGRAALRDKLMSQQKDALRKRKQPPTTVLSLLRQSQMDSSAVPKPGPDLLRKQGQGSFPISSMSQLLQSMSCQSSHLSSNSTPGCGASNTALPCSANQLHFTDPSMNSSVLQNIPLRGEAVHCHNANTNFVHSNSPVPNHHLAGLINQIQASGNCGMLSQSGMALGNSLHPNPPQSRISTSSTPVIPNSIVSSYNQTSSEAGGSGPSSSIAIAGTNHPAITKTTSVLQDGVIVTTAAGNPLQSQLPIGSDFPFVGQEHALHFPSNSTSNNHLPHPLNPSLLSSLPISLPVNQQHLLNQNLLNILQPSAGEGDMSSINNTLSNHQLTHLQSLLNNNQMFPPNQQQQQLLQGYQNLQAFQGQSTIPCPANNNPMACLFQNFQVRMQEDAALLNKRISTQPGLTALPENPNTTLPPFQDTPCGAREVEDTNRRFGSLQPCPEKEQKKWKAK

SEQ ID NO: 50890 - protein, 1003 aa, Homo sapiens
  Payload ID: 10165
  Gene Symbol: MBD6
  Gene Name: methyl-CpG binding domain protein 6
  Uniprot ID: Q96DN6
  ENSP ID: ENSP00000347896
MNGGNESSGADRAGGPVATSVPIGWQRCVREGAVLYISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPPCRVPPTTPLNGGPGSLPPEPPSVSQAFPTLAGPGGLFPPRLADPVPSGGSSSPRFLPRGNAPSPAPPPPPAISLNAPSYNWGAALRSSLVPSDLGSPPAPHASSSPPSDPPLFHCSDALTPPPLPPSNNLPAHPGPASQPPVSSATMHLPLVLGPLGGAPTVEGPGAPPFLASSLLSAAAKAQHPPLPPPSTLQGRRPRAQAPSASHSSSLRPSQRRPRRPPTVFRLLEGRGPQTPRRSRPRAPAPVPQPFSLPEPSQPILPSVLSLLGLPTPGPSHSDGSFNLLGSDAHLPPPPTLSSGSPPQPRHPIQPSLPGTTSGSLSSVPGAPAPPAASKAPVVPSPVLQSPSEGLGMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 50891 - protein, 66 aa, Homo sapiens
  Payload ID: 10165
  Gene Symbol: MBD6
  Gene Name: methyl-CpG binding domain protein 6
  ENSP ID: ENSP00000446481
MTKLCNHRRKAVAMATLYRSMETTCSHSSPGEGASPQMFHTVSPGPPSARPPCRVPPTTPLNGGPG

SEQ ID NO: 50892 - protein, 176 aa, Homo sapiens
  Payload ID: 10165
  Gene Symbol: MBD6
  Gene Name: methyl-CpG binding domain protein 6
  ENSP ID: ENSP00000446834
ESSGADRAGGPVATSVPIGWQRCVREGAVLYISPSGTELSSLEQTRSYLLSDGTCKCGLECPLNVPKVFNFDPLAPVTPGGAGVGPASEEDMTKLCNHRRKAVAMATLYRSMETTCSHSSPGSPPQPRHPIQPSLPGTTSGSLSSVPGAPAPPAASKAPVVPSPVLQSPSEGLGMG

SEQ ID NO: 50893 - protein, 45 aa, Homo sapiens
  Payload ID: 10165
  Gene Symbol: MBD6
  Gene Name: methyl-CpG binding domain protein 6
  ENSP ID: ENSP00000447365
MNGGNESSGADRAGGPVATSVPIGWQRCVREGAVLYISPSGTELS

SEQ ID NO: 50894 - protein, 27 aa, Homo sapiens
  Payload ID: 10165
  Gene Symbol: MBD6
  Gene Name: methyl-CpG binding domain protein 6
  ENSP ID: ENSP00000447418
  MOD_RES (1)..(1): Any amino acid
XARAAVPLPPRARPGRPAKNKRRKLAP

SEQ ID NO: 50895 - protein, 148 aa, Homo sapiens
  Payload ID: 10165
  Gene Symbol: MBD6
  Gene Name: methyl-CpG binding domain protein 6
  ENSP ID: ENSP00000448070
MNGGNESSGADRAGGPVATSVPIGWQRCVREGAVLYISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPP

SEQ ID NO: 50896 - protein, 53 aa, Homo sapiens
  Payload ID: 10165
  Gene Symbol: MBD6
  Gene Name: methyl-CpG binding domain protein 6
  ENSP ID: ENSP00000448202
MNGGNESSGADRAGGPVATSVPIGWQRCVREGAVLYISPSGTELSSLEQTRSY

SEQ ID NO: 50897 - protein, 47 aa, Homo sapiens
  Payload ID: 10165
  Gene Symbol: MBD6
  Gene Name: methyl-CpG binding domain protein 6
  ENSP ID: ENSP00000449541
MNGGNESSGADRAGGPVATSVPIGWQRCVREGAVLYIRRICNLSTVL

SEQ ID NO: 50898 - protein, 73 aa, Homo sapiens
  Payload ID: 10165
  Gene Symbol: MBD6
  Gene Name: methyl-CpG binding domain protein 6
  ENSP ID: ENSP00000449603
MNGGNESSGADRAGGPVATSVPIGWQRCVREGAVLYISPSGTELSSLEQTRSYLLSDGTCKCGLECPLNVPKV

SEQ ID NO: 50899 - protein, 504 aa, Homo sapiens
  Payload ID: 10165
  Gene Symbol: MBD6
  Gene Name: methyl-CpG binding domain protein 6
  ENSP ID: ENSP00000449749
GMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 50900 - protein, 190 aa, Homo sapiens
  Payload ID: 10165
  Gene Symbol: MBD6
  Gene Name: methyl-CpG binding domain protein 6
  ENSP ID: ENSP00000450160
  MOD_RES (1)..(1): Any amino acid
XLLSGQLGLQLLPGGGAPPPLSEASSPLACLLQSLQQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRR

SEQ ID NO: 50901 - protein, 53 aa, Homo sapiens; identical to SEQ ID NO: 50896
  Payload ID: 10165
  Gene Symbol: MBD6
  Gene Name: methyl-CpG binding domain protein 6
  ENSP ID: ENSP00000450370

SEQ ID NO: 50902 - protein, 725 aa, Homo sapiens
  Payload ID: 10166
  Gene Symbol: MCCC1
  Gene Name: methylcrotonoyl-CoA carboxylase 1 (alpha)
  Uniprot ID: Q96RQ3
  ENSP ID: ENSP00000265594
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 50903 - protein, 47 aa, Homo sapiens
  Payload ID: 10166
  Gene Symbol: MCCC1
  Gene Name: methylcrotonoyl-CoA carboxylase 1 (alpha)
  ENSP ID: ENSP00000418979
MAAASAVSVLLVAAERNRWHRLPSLLLPPRTWVWRQRTMKYTTATGR

SEQ ID NO: 50904 - protein, 56 aa, Homo sapiens
  Payload ID: 10166
  Gene Symbol: MCCC1
  Gene Name: methylcrotonoyl-CoA carboxylase 1 (alpha)
  ENSP ID: ENSP00000419328
MAAASAVSVLLVAAERNRWHRLPSLLLPPRLSIQDAVFSQKTWNLLNFVSKKELFL

SEQ ID NO: 50905 - protein, 61 aa, Homo sapiens
  Payload ID: 10166
  Gene Symbol: MCCC1
  Gene Name: methylcrotonoyl-CoA carboxylase 1 (alpha)
  ENSP ID: ENSP00000419658
MAAASAVSVLLVAAERNRWHRLPSLLLPPRTWVWRQRTMKYTTATGYPSRMRFSLRKHGIC

SEQ ID NO: 50906 - protein, 616 aa, Homo sapiens
  Payload ID: 10166
  Gene Symbol: MCCC1
  Gene Name: methylcrotonoyl-CoA carboxylase 1 (alpha)
  ENSP ID: ENSP00000419898
MEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 50907 - protein, 47 aa, Homo sapiens; identical to SEQ ID NO: 50903
  Payload ID: 10166
  Gene Symbol: MCCC1
  Gene Name: methylcrotonoyl-CoA carboxylase 1 (alpha)
  ENSP ID: ENSP00000420088

SEQ ID NO: 50908 - protein, 112 aa, Homo sapiens
  Payload ID: 10166
  Gene Symbol: MCCC1
  Gene Name: methylcrotonoyl-CoA carboxylase 1 (alpha)
  ENSP ID: ENSP00000420223
MAAASAVSVLLVAAERNRWHRLPSLLLPPRTWVWRQRTMKYTTATGRNITKVLIANRGEIACRVMRTAKKLGVQTVAVYSEADRNSMHVDMQDDLDFTEKIKLRFLPQNLLT

SEQ ID NO: 50909 - protein, 598 aa, Homo sapiens
  Payload ID: 10166
  Gene Symbol: MCCC1
  Gene Name: methylcrotonoyl-CoA carboxylase 1 (alpha)
  ENSP ID: ENSP00000420433
MAAASAVSVLLVAAERNRWHRLPSLLLPPRTWVWRQRTMKYTTATDEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQET

SEQ ID NO: 50910 - protein, 61 aa, Homo sapiens; identical to SEQ ID NO: 50905
  Payload ID: 10166
  Gene Symbol: MCCC1
  Gene Name: methylcrotonoyl-CoA carboxylase 1 (alpha)
  ENSP ID: ENSP00000420591

SEQ ID NO: 50911 - protein, 434 aa, Homo sapiens
  Payload ID: 10166
  Gene Symbol: MCCC1
  Gene Name: methylcrotonoyl-CoA carboxylase 1 (alpha)
  ENSP ID: ENSP00000420648
MKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNINSLHFRLAVEED

SEQ ID NO: 50912 - protein, 575 aa, Homo sapiens
  Payload ID: 10166
  Gene Symbol: MCCC1
  Gene Name: methylcrotonoyl-CoA carboxylase 1 (alpha)
  ENSP ID: ENSP00000441253
MEKIIQVAKTSAAQHIQSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 50913 - protein, 575 aa, Homo sapiens; identical to SEQ ID NO: 50912
  Payload ID: 10166
  Gene Symbol: MCCC1
  Gene Name: methylcrotonoyl-CoA carboxylase 1 (alpha)
  ENSP ID: ENSP00000480435

SEQ ID NO: 50914 - protein, 434 aa, Homo sapiens; identical to SEQ ID NO: 50911
  Payload ID: 10166
  Gene Symbol: MCCC1
  Gene Name: methylcrotonoyl-CoA carboxylase 1 (alpha)
  ENSP ID: ENSP00000486824

SEQ ID NO: 50915 - protein, 563 aa, Homo sapiens
  Payload ID: 10167
  Gene Symbol: MCCC2
  Gene Name: methylcrotonoyl-CoA carboxylase 2 (beta)
  Uniprot ID: Q9HCC0
  ENSP ID: ENSP00000343657
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 50916 - protein, 363 aa, Homo sapiens
  Payload ID: 10167
  Gene Symbol: MCCC2
  Gene Name: methylcrotonoyl-CoA carboxylase 2 (beta)
  ENSP ID: ENSP00000420994
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGIKVKN

SEQ ID NO: 50917 - protein, 329 aa, Homo sapiens
  Payload ID: 10167
  Gene Symbol: MCCC2
  Gene Name: methylcrotonoyl-CoA carboxylase 2 (beta)
  ENSP ID: ENSP00000423202
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGIKPLEKHKT

SEQ ID NO: 50918 - protein, 286 aa, Homo sapiens
  Payload ID: 10167
  Gene Symbol: MCCC2
  Gene Name: methylcrotonoyl-CoA carboxylase 2 (beta)
  ENSP ID: ENSP00000425474
MADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREKFFMKYFLRLDLNSYNSTWQHGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFE

SEQ ID NO: 50919 - protein, 208 aa, Homo sapiens
  Payload ID: 10167
  Gene Symbol: MCCC2
  Gene Name: methylcrotonoyl-CoA carboxylase 2 (beta)
  ENSP ID: ENSP00000478750
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQ

SEQ ID NO: 50920 - protein, 208 aa, Homo sapiens; identical to SEQ ID NO: 50919
  Payload ID: 10167
  Gene Symbol: MCCC2
  Gene Name: methylcrotonoyl-CoA carboxylase 2 (beta)
  ENSP ID: ENSP00000483794

SEQ ID NO: 50921 - protein, 208 aa, Homo sapiens; identical to SEQ ID NO: 50919
  Payload ID: 10167
  Gene Symbol: MCCC2
  Gene Name: methylcrotonoyl-CoA carboxylase 2 (beta)
  ENSP ID: ENSP00000486062

SEQ ID NO: 50922 - protein, 208 aa, Homo sapiens; identical to SEQ ID NO: 50919
  Payload ID: 10167
  Gene Symbol: MCCC2
  Gene Name: methylcrotonoyl-CoA carboxylase 2 (beta)
  ENSP ID: ENSP00000486135

SEQ ID NO: 50923 - protein, 329 aa, Homo sapiens; identical to SEQ ID NO: 50917
  Payload ID: 10167
  Gene Symbol: MCCC2
  Gene Name: methylcrotonoyl-CoA carboxylase 2 (beta)
  ENSP ID: ENSP00000486535

SEQ ID NO: 50924 - protein, 208 aa, Homo sapiens; identical to SEQ ID NO: 50919
  Payload ID: 10167
  Gene Symbol: MCCC2
  Gene Name: methylcrotonoyl-CoA carboxylase 2 (beta)
  ENSP ID: ENSP00000486592

SEQ ID NO: 50925 - protein, 935 aa, Homo sapiens [sequence omitted]

SEQ ID NO: 50926 - protein, 1020 aa, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  ENSP ID: ENSP00000438588
MRHRVCRGRSGQGRRRSSVIPWPVPKHVGWVVLLGCGGSGTSILVVSIVGSGLIKAMAPAEILNGKEISAQIRARLKNQVTQLKEQVPGFTPRLAILQVGNRDDSNLYINVKLKAAEEIGIKATHIKLPRTTTESEVMKYITSLNEDSTVHGFLVQLPLDSENSINTEEVINAIAPEKDVDGLTSINAGKLARGDLNDCFIPCTPKGCLELIKETGVPIAGRHAVVVGRSKIVGAPMHDLLLWNNATVTTCHSKTAHLDEEVNKGDILVVATGQPEMVKGEWIKPGAIVIDCGINYVPDDKKPNGRKVVGDVAYDEAKERASFITPVPGGVGPMTVAMLMQSTVESAKRFLEKFKPGKWMIQYNNLNLKTPVPSDIDISRSCKPKPIGKLAREIGLLSEEVELYGETKAKVLLSALERLKHRPDGKYVVVTGITPTPLGEGKSTTTIGLVQALGAHLYQNVFACVRQPSQGPTFGIKGGAAGGGYSQVIPMEEFNLHLTGDIHAITAANNLVAAAIDARIFHELTQTDKALFNRLVPSVNGVRRFSDIQIRRLKRLGIEKTDPTTLTDEEINRFARLDIDPETITWQRVLDTNDRFLRKITIGQAPTEKGHTRTAQFDISVASEIMAVLALTTSLEDMRERLGKMVVASSKKGEPVSAEDLGVSGALTVLMKDAIKPNLMQTLEGTPVFVHAGPFANIAHGNSSIIADRIALKLVGPEGFVVTEAGFGADIGMEKFFNIKCRYSGLCPHVVVLVATVRALKMHGGGPTVTAGLPLPKAYIQENLELVEKGFSNLKKQIENARMFGIPVVVAVNAFKTDTESELDLISRLSREHGAFDAVKCTHWAEGGKGALALAQAVQRAAQAPSSFQLLYDLKLPVEDKIRIIAQKIYGADDIELLPEAQHKAEVYTKQGFGNLPICMAKTHLSLSHNPEQKGVPTGFILPIRDIRASVGAGFLYPLVGTITIHLQEATLKVWPVSIQAHWELGSISKPREVSPCPEDLKLIVGVSPEVIFSLNSHHV

SEQ ID NO: 50927 - protein, 261 aa, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  Uniprot ID: P11586
  ENSP ID: ENSP00000450560
MRHRVCRGRSGQGRRRSSVIPWPVPKHVGWVVLLGCGGSGTSILVVSIVGSGLIKAMAPAEILNGKEISAQIRARLKNQVTQLKEQVPGFTPRLAILQVGNRDDSNLYINVKLKAAEEIGIKATHIKLPRTTTESEVMKYITSLNEDSTVHGFLVQLPLDSENSINTEEVINAIAPEKDVDGLTSINAGKLARGDLNDCFIPCTPKGCLELIKETGVPIAGRHAVVVGRSKIVGAPMHDLLLWNNATVTTCHSKTAHLDEE

SEQ ID NO: 50928 - protein, 68 aa, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  ENSP ID: ENSP00000476468
MKYITSLNEDSTVHGFLVQLPLDSENSINTEEVINAIAPEKDVDGLTSINAGKLARGDLNDCFIPCTP

SEQ ID NO: 50929 - protein, 107 aa, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  ENSP ID: ENSP00000477199
YDLKLPVEDKIRIIAQKIYGADDIELLPEAQHKAEVYTKQGFGNLPICMAKTHLSLSHNPEQKGVPTGFILPIRDIRASVGAGFLYPLVGTVSACCKGVVGASALLV

SEQ ID NO: 50930 - protein, 23 aa, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  ENSP ID: ENSP00000477359
MKYITSLNEDSTVHGFLVQLPLD

SEQ ID NO: 50931 - protein, 25 aa, Homo sapiens
  Payload ID: 10168
  Gene Symbol: MTHFD1
  Gene Name: methylenetetrahydrofolate dehydrogenase (NADP+ dependent) 1, methenyltetrahydrofolate cyclohydrolase, formyltetrahydrofo late synthetase
  ENSP ID: ENSP00000477501
MKYITSLNEDSTVHGFLVQLPLDSE

SEQ ID NO: 50932 - protein, 275 aa, Homo sapiens
  Payload ID: 10169
  Gene Symbol: MTHFD1L
  Gene Name: methylenetetrahydrofolate dehydrogenase (NADP+ dependent) 1-like
  Uniprot ID: Q6UB35
  ENSP ID: ENSP00000356276
MGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSGVNLDGKKILVVGAHGSLEAALQCLFQRKGSMTMSIQWKTRQLQSKTESRSVTRLECRRVI

SEQ ID NO: 50933 - protein, 332 aa, Homo sapiens
  Payload ID: 10169
  Gene Symbol: MTHFD1L
  Gene Name: methylenetetrahydrofolate dehydrogenase (NADP+ dependent) 1-like
  ENSP ID: ENSP00000356277
  MOD_RES (1)..(1): Any amino acid
XGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTP

SEQ ID NO: 50934 - protein, 978 aa, Homo sapiens
  Payload ID: 10169
  Gene Symbol: MTHFD1L
  Gene Name: methylenetetrahydrofolate dehydrogenase (NADP+ dependent) 1-like
  Uniprot ID: Q6UB35
  ENSP ID: ENSP00000356290
MGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 50935 - protein, 92 aa, Homo sapiens
  Payload ID: 10169
  Gene Symbol: MTHFD1L
  Gene Name: methylenetetrahydrofolate dehydrogenase (NADP+ dependent) 1-like
  ENSP ID: ENSP00000391022
VYGAKDIELSPEAQAKIDRYTQQGFGNLPICMAKTHLSLSHQPDKKGVPRDFILPISDVRASIGAGFIYPLVGTRSSPLALVGESQPKQVHP

SEQ ID NO: 50936 - protein, 96 aa, Homo sapiens
  Payload ID: 10169
  Gene Symbol: MTHFD1L
  Gene Name: methylenetetrahydrofolate dehydrogenase (NADP+ dependent) 1-like
  ENSP ID: ENSP00000395158
NIQLVADGCCNLQKQIQITQLFGVPVVVALNVFKTDTRAEIDLVCELAKRAGAFDAVPCYHWSVGGKGSVDLARAVREAASKRSRFQFLYDVQPFS

SEQ ID NO: 50937 - protein, 57 aa, Homo sapiens
  Payload ID: 10169
  Gene Symbol: MTHFD1L
  Gene Name: methylenetetrahydrofolate dehydrogenase (NADP+ dependent) 1-like
  ENSP ID: ENSP00000399804
NLPICMAKTHLSLSHQPDKKGVPRDFILPISDVRASIGAGFIYPLVGTGGREAPLWL

SEQ ID NO: 50938 - protein, 114 aa, Homo sapiens
  Payload ID: 10169
  Gene Symbol: MTHFD1L
  Gene Name: methylenetetrahydrofolate dehydrogenase (NADP+ dependent) 1-like
  ENSP ID: ENSP00000400776
MQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSGVNLDGKKIL

SEQ ID NO: 50939 - protein, 108 aa, Homo sapiens
  Payload ID: 10169
  Gene Symbol: MTHFD1L
  Gene Name: methylenetetrahydrofolate dehydrogenase (NADP+ dependent) 1-like
  ENSP ID: ENSP00000407070
MQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSASRG

SEQ ID NO: 50940 - protein, 979 aa, Homo sapiens
  Payload ID: 10169
  Gene Symbol: MTHFD1L
  Gene Name: methylenetetrahydrofolate dehydrogenase (NADP+ dependent) 1-like
  ENSP ID: ENSP00000478253
MGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 50941 - protein, 913 aa, Homo sapiens
  Payload ID: 10169
  Gene Symbol: MTHFD1L
  Gene Name: methylenetetrahydrofolate dehydrogenase (NADP+ dependent) 1-like
  ENSP ID: ENSP00000479539
MQSRRARPRREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSVGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 50942 - protein, 350 aa, Homo sapiens
  Payload ID: 10170
  Gene Symbol: MTHFD2
  Gene Name: methylenetetrahydrofolate dehydrogenase (NADP+ dependent) 2, methenyltetrahydrofolate cyclohydrolase
  Uniprot ID: P13995
  ENSP ID: ENSP00000377617
MAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 50943 - protein, 222 aa, Homo sapiens
  Payload ID: 10170
  Gene Symbol: MTHFD2
  Gene Name: methylenetetrahydrofolate dehydrogenase (NADP+ dependent) 2, methenyltetrahydrofolate cyclohydrolase
  ENSP ID: ENSP00000386536
MAATSLMSALAARLLQPAHSCSLRLRPFHLAAVRNEAVVISGRKLAQQIKQEVRQEVEEWVASGNKRPHLSVILVGENPASHSYVLNKTRAAAVVGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 50944 - protein, 267 aa, Homo sapiens
  Payload ID: 10170
  Gene Symbol: MTHFD2
  Gene Name: methylenetetrahydrofolate dehydrogenase (NADP+ dependent) 2, methenyltetrahydrofolate cyclohydrolase
  ENSP ID: ENSP00000386542
MAATSLMSALAARLLQPAHSCSLRLRPFHLAAVRNEAVVISGRKLAQQIKQEVRQEVEEWVASGNKRPHLSVILVGENPASHSYVLNKTRAAAVVEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGVRQKAGYITPVPGGVGPMTVAMLMKNTIIAAKKVLRLEEREVLKSKELGVATN

SEQ ID NO: 50945 - protein, 37 aa, Homo sapiens
  Payload ID: 10170
  Gene Symbol: MTHFD2
  Gene Name: methylenetetrahydrofolate dehydrogenase (NADP+ dependent) 2, methenyltetrahydrofolate cyclohydrolase
  ENSP ID: ENSP00000419067
MAATSLMSALAARLLQPAHSCSLRLRPFHLAAVRNQQ

SEQ ID NO: 50946 - protein, 36 aa, Homo sapiens
  Payload ID: 10170
  Gene Symbol: MTHFD2
  Gene Name: methylenetetrahydrofolate dehydrogenase (NADP+ dependent) 2, methenyltetrahydrofolate cyclohydrolase
  ENSP ID: ENSP00000419550
MAATSLMSALAARLLQPAHSCSLRLRPFHLAAVRAY

SEQ ID NO: 50947 - protein, 289 aa, Homo sapiens
  Payload ID: 10171
  Gene Symbol: MTHFD2L
  Gene Name: methylenetetrahydrofolate dehydrogenase (NADP+ dependent) 2-like
  Uniprot ID: Q9H903
  ENSP ID: ENSP00000321984
MAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFEAVKKKAGFITPVPGGVGPMTVAMLLKNTLLAAKKIIY

SEQ ID NO: 50948 - protein, 252 aa, Homo sapiens
  Payload ID: 10171
  Gene Symbol: MTHFD2L
  Gene Name: methylenetetrahydrofolate dehydrogenase (NADP+ dependent) 2-like
  ENSP ID: ENSP00000352012
MAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFE

SEQ ID NO: 50949 - protein, 347 aa, Homo sapiens
  Payload ID: 10171
  Gene Symbol: MTHFD2L
  Gene Name: methylenetetrahydrofolate dehydrogenase (NADP+ dependent) 2-like
  Uniprot ID: Q9H903
  ENSP ID: ENSP00000379108
MTVPVRGFSLLRGRLGRAPALGRSTAPSVRAPGEPGSAFRGFRSSGVRHEAIIISGTEMAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFEAVKKKAGFITPVPGGVGPMTVAMLLKNTLLAAKKIIY

SEQ ID NO: 50950 - protein, 106 aa, Homo sapiens
  Payload ID: 10171
  Gene Symbol: MTHFD2L
  Gene Name: methylenetetrahydrofolate dehydrogenase (NADP+ dependent) 2-like
  ENSP ID: ENSP00000387614
MAKHIQKEIQRGVESWVSLGNRRPHLSIILVGDNPASHTYVRNKIRAASAVGICSELILKPKDVSQEELLDVTDQLNMDPRVSGILVQLPLPEAVQLCSGFEMLGI

SEQ ID NO: 50951 - protein, 223 aa, Homo sapiens
  Payload ID: 10171
  Gene Symbol: MTHFD2L
  Gene Name: methylenetetrahydrofolate dehydrogenase (NADP+ dependent) 2-like
  Uniprot ID: Q9H903
  ENSP ID: ENSP00000391327
MAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAERFHHFAQDLSNS

SEQ ID NO: 50952 - protein, 146 aa, Homo sapiens
  Payload ID: 10171
  Gene Symbol: MTHFD2L
  Gene Name: methylenetetrahydrofolate dehydrogenase (NADP+ dependent) 2-like
  ENSP ID: ENSP00000405692
MDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAERFHHFAQDLSNS

SEQ ID NO: 50953 - protein, 106 aa, Homo sapiens; identical to SEQ ID NO: 50950
  Payload ID: 10171
  Gene Symbol: MTHFD2L
  Gene Name: methylenetetrahydrofolate dehydrogenase (NADP+ dependent) 2-like
  ENSP ID: ENSP00000409391

SEQ ID NO: 50954 - protein, 29 aa, Homo sapiens
  Payload ID: 10172
  Gene Symbol: MTHFR
  Gene Name: methylenetetrahydrofolate reductase (NAD(P)H)
  ENSP ID: ENSP00000365669
MVNEARGNSSLNPCLEGSASSGSESSKDS

SEQ ID NO: 50955 - protein, 697 aa, Homo sapiens
  Payload ID: 10172
  Gene Symbol: MTHFR
  Gene Name: methylenetetrahydrofolate reductase (NAD(P)H)
  Uniprot ID: P42898
  ENSP ID: ENSP00000365767
MDHRKARVLPAGHYCPSLGIWASQVGSVRSSVPPSISRNPAMVNEARGNSSLNPCLEGSASSGSESSKDSSRCSTPGLDPERHERLREKMRRRLESGDKWFSLEFFPPRTAEGAVNLISRFDRMAAGGPLYIDVTWHPAGDPGSDKETSSMMIASTAVNYCGLETILHMTCCRQRLEEITGHLHKAKQLGLKNIMALRGDPIGDQWEEEEGGFNYAVDLVKHIRSEFGDYFDICVAGYPKGHPEAGSFEADLKHLKEKVSAGADFIITQLFFEADTFFRFVKACTDMGITCPIVPGIFPIQGYHSLRQLVKLSKLEVPQEIKDVIEPIKDNDAAIRNYGIELAVSLCQELLASGLVPGLHFYTLNREMATTEVLKRLGMWTEDPRRPLPWALSAHPKRREEDVRPIFWASRPKSYIYRTQEWDEFPNGRWGNSSSPAFGELKDYYLFYLKSKSPKEELLKMWGEELTSEESVFEVFVLYLSGEPNRNGHKVTCLPWNDEPLAAETSLLKEELLRVNRQGILTINSQPNINGKPSSDPIVGWGPSGGYVFQKAYLEFFTSRETAEALLQVLKKYELRVNYHLVNVKGENITNAPELQPNAVTWGIFPGREIIQPTVVDPVSFMFWKDEAFALWIERWGKLYEEESPSRTIIQYIHDNYFLVNLVDNDFPLDNCLWQVVEDTLELLNRPTQNARETEAP

SEQ ID NO: 50956 - protein, 697 aa, Homo sapiens; identical to SEQ ID NO: 50955
  Payload ID: 10172
  Gene Symbol: MTHFR
  Gene Name: methylenetetrahydrofolate reductase (NAD(P)H)
  Uniprot ID: P42898
  ENSP ID: ENSP00000365770

SEQ ID NO: 50957 - protein, 656 aa, Homo sapiens [sequence omitted]

SEQ ID NO: 50958 - protein, 656 aa, Homo sapiens [sequence omitted]

SEQ ID NO: 50959 - protein, 52 aa, Homo sapiens
  Payload ID: 10172
  Gene Symbol: MTHFR
  Gene Name: methylenetetrahydrofolate reductase (NAD(P)H)
  ENSP ID: ENSP00000398908
MCRGCGCLPPDAPCPTLCSRNPAMVNEARGNSSLNPCLEGSASSGSESSKDS

SEQ ID NO: 50960 - protein, 29 aa, Homo sapiens
  Payload ID: 10172
  Gene Symbol: MTHFR
  Gene Name: methylenetetrahydrofolate reductase (NAD(P)H)
  ENSP ID: ENSP00000400460
MVNEARGNSSLNPCLEGSASSGSESSKDS

SEQ ID NO: 50961 - protein, 143 aa, Homo sapiens
  Payload ID: 10172
  Gene Symbol: MTHFR
  Gene Name: methylenetetrahydrofolate reductase (NAD(P)H)
  ENSP ID: ENSP00000405082
MVNEARGNSSLNPCLEGSASSGSESSKDSSRCSTPGLDPERHERLREKMRRRLESGDKWFSLEFFPPRTAEGAVNLISRFDRMAAGGPLYIDVTWHPAGDPGSDKETSSMMIASTAVNYCGLETILHMTCCRQRLEEITGHLH

SEQ ID NO: 50962 - protein, 29 aa, Homo sapiens
  Payload ID: 10172
  Gene Symbol: MTHFR
  Gene Name: methylenetetrahydrofolate reductase (NAD(P)H)
  ENSP ID: ENSP00000408307
MVNEARGNSSLNPCLEGSASSGSESSKDS

SEQ ID NO: 50963 - protein, 418 aa, Homo sapiens
  Payload ID: 10173
  Gene Symbol: MMAA
  Gene Name: methylmalonic aciduria (cobalamin deficiency) cblA type
  Uniprot ID: Q8IVH4
  ENSP ID: ENSP00000281317
MPMLLPHPHQHFLKGLLRAPFRCYHFIFHSSTHLGSGIPCAQPFNSLGLHCTKWMLLSDGLKRKLCVQTTLKDHTEGLSDKEQRFVDKLYTGLIQGQRACLAEAITLVESTHSRKKELAQVLLQKVLLYHREQEQSNKGKPLAFRVGLSGPPGAGKSTFIEYFGKMLTERGHKLSVLAVDPSSCTSGGSLLGDKTRMTELSRDMNAYIRPSPTRGTLGGVTRTTNEAILLCEGAGYDIILIETVGVGQSEFAVADMVDMFVLLLPPAGGDELQGIKRGIIEMADLVAVTKSDGDLIVPARRIQAEYVSALKLLRKRSQVWKPKVIRISARSGEGISEMWDKMKDFQDLMLASGELTAKRRKQQKVWMWNLIQESVLEHFRTHPTVREQIPLLEQKVLIGALSPGLAADFLLKAFKSRD

SEQ ID NO: 50964 - protein, 260 aa, Homo sapiens
  Payload ID: 10173
  Gene Symbol: MMAA
  Gene Name: methylmalonic aciduria (cobalamin deficiency) cblA type
  ENSP ID: ENSP00000427422
MPMLLPHPHQHFLKGLLRAPFRCYHFIFHSSTHLGSGIPCAQPFNSLGLHCTKWMLLSDGLKRKLCVQTTLKDHTEGLSDKEQRFVDKLYTGLIQGQRACLAEAITLVESTHSRKKELAQVLLQKVLLYHREQEQSNKGKPLAFRVGLSGPPGAGKSTFIEYFGKMLTERGHKLSVLAVDPSSCTSGGSLLGDKTRMTELSRDMNAYIRPSPTRGTLGGVTRTTNEAILLCEGAGYDIILIETVGYQKGYNRDGRSGSCN

SEQ ID NO: 50965 - protein, 424 aa, Homo sapiens
  Payload ID: 10173
  Gene Symbol: MMAA
  Gene Name: methylmalonic aciduria (cobalamin deficiency) cblA type
  ENSP ID: ENSP00000442284
MPMLLPHPHQHFLKGLLRAPFRCYHFIFHSSTHLGSGIPCAQPFNSLGLHCTKWMLLSDGLKRKLCVQTTLKDHTEGLSDKEQRFVDKLYTGLIQGQRACLAEAITLVESTHSRKKELAQVLLQKVLLYHREQEQSNKGKPLAFRVGLSGPPGAGKSTFIEYFGKMLTERGHKLSVLAVDPSSCTSGGSLLGDKTRMTELSRDMNAYIRPSPTRGTLGGVTRTTNEAILLCEGAGYDIILIETVGVGQSEFAVADMVDMFVLLLPPAGGDELQGIKRGIIEMADLVAVTKSDGDLIVPARRIQAEYVSALKLLRKRSQVWKPKVIRISARSGEGISEMWDKMKDFQDLMLASGELTAKRRKQQKVWMWNLIQESVLEHFRTHPTVREQIPLLEQKVLIGALSPGLAADFLLKALKAETNKIHPV

SEQ ID NO: 50966 - protein, 97 aa, Homo sapiens
  Payload ID: 10174
  Gene Symbol: MMAB
  Gene Name: methylmalonic aciduria (cobalamin deficiency) cblB type
  ENSP ID: ENSP00000416136
MAVCGLGSRLGLGSRLGLRGCFGAARLLYPRFQSRGPQGVEDGDRPQPSSKTPRIPKIYTKTGDKETGICHVGQASLELLASSDLPTMASQSPGITV

SEQ ID NO: 50967 - protein, 47 aa, Homo sapiens
  Payload ID: 10174
  Gene Symbol: MMAB
  Gene Name: methylmalonic aciduria (cobalamin deficiency) cblB type
  ENSP ID: ENSP00000438079
MAVCGLGSRLGLGSRLGLRGCFGAARLLYPRFQSRGPQGVEDGDRVF

SEQ ID NO: 50968 - protein, 173 aa, Homo sapiens
  Payload ID: 10174
  Gene Symbol: MMAB
  Gene Name: methylmalonic aciduria (cobalamin deficiency) cblB type
  ENSP ID: ENSP00000444793
MAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIGFALELVTEKGHTFAEELQKIQCTLQDVGSALATPCSSAREAHLKYTTFKAGPILELEQWIDKYTSQLPPLTAFILP

SEQ ID NO: 50969 - protein, 250 aa, Homo sapiens
  Payload ID: 10174
  Gene Symbol: MMAB
  Gene Name: methylmalonic aciduria (cobalamin deficiency) cblB type
  Uniprot ID: Q96EY8
  ENSP ID: ENSP00000445920
MAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIGFALELVTEKGHTFAEELQKIQCTLQDVGSALATPCSSAREAHLKYTTFKAGPILELEQWIDKYTSQLPPLTAFILPSGGKISSALHFCRAVCRRAERRVVPLVQMGETDANVAKFLNRLSDYLFTLARYAAMKEGNQEKIYMKNDPSAESEGL

SEQ ID NO: 50970 - protein, 198 aa, Homo sapiens
  Payload ID: 10174
  Gene Symbol: MMAB
  Gene Name: methylmalonic aciduria (cobalamin deficiency) cblB type
  ENSP ID: ENSP00000474582
MAVCGLGSRLGLGSRLGLRGCFGAARLLYPRFQSRGPQGVEDGDRFALELVTEKGHTFAEELQKIQCTLQDVGSALATPCSSAREAHLKYTTFKAGPILELEQWIDKYTSQLPPLTAFILPSGGKISSALHFCRAVCRRAERRVVPLVQMGETDANVAKFLNRLSDYLFTLARYAAMKEGNQEKIYMKNDPSAESEGL

SEQ ID NO: 50971 - protein, 148 aa, Homo sapiens
  Payload ID: 10174
  Gene Symbol: MMAB
  Gene Name: methylmalonic aciduria (cobalamin deficiency) cblB type
  ENSP ID: ENSP00000474881
MAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIGRSFALVAQTGVQWCDLGSLQPLPPGFKRVSSLLLFLTLTCSWLPFLHGGPD

SEQ ID NO: 50972 - protein, 173 aa, Homo sapiens; identical to SEQ ID NO: 50968
  Payload ID: 10174
  Gene Symbol: MMAB
  Gene Name: methylmalonic aciduria (cobalamin deficiency) cblB type
  ENSP ID: ENSP00000474981

SEQ ID NO: 50973 - protein, 97 aa, Homo sapiens
  Payload ID: 10174
  Gene Symbol: MMAB
  Gene Name: methylmalonic aciduria (cobalamin deficiency) cblB type
  ENSP ID: ENSP00000483818
MAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIG

SEQ ID NO: 50974 - protein, 282 aa, Homo sapiens
  Payload ID: 10175
  Gene Symbol: MMACHC
  Gene Name: methylmalonic aciduria (cobalamin deficiency) cblC type, with homocystinuria
  Uniprot ID: Q9Y4U1
  ENSP ID: ENSP00000383840
MEPKVAELKQKIEDTLCPFGFEVYPFQVAWYNELLPPAFHLPLPGPTLAFLVLSTPAMFDRALKPFLQSCHLRMLTDPVDQCVAYHLGRVRESLPELQIEIIADYEVHPNRRPKILAQTAAHVAGAAYYYQRQDVEADPWGNQRISGVCIHPRFGGWFAIRGVVLLPGIEVPDLPPRKPHDCVPTRADRIALLEGFNFHWRDWTYRDAVTPQERYSEEQKAYFSTPPAQRLALLGLAQPSEKPSSPSPDLPFTTPAPKKPGNPSRARSWLSPRVSPPASPGP

SEQ ID NO: 50975 - protein, 225 aa, Homo sapiens
  Payload ID: 10175
  Gene Symbol: MMACHC
  Gene Name: methylmalonic aciduria (cobalamin deficiency) cblC type, with homocystinuria
  ENSP ID: ENSP00000478859
MFDRALKPFLQSCHLRMLTDPVDQCVAYHLGRVRESLPELQIEIIADYEVHPNRRPKILAQTAAHVAGAAYYYQRQDVEADPWGNQRISGVCIHPRFGGWFAIRGVVLLPGIEVPDLPPRKPHDCVPTRADRIALLEGFNFHWRDWTYRDAVTPQERYSEEQKAYFSTPPAQRLALLGLAQPSEKPSSPSPDLPFTTPAPKKPGNPSRARSWLSPRVSPPASPGP

SEQ ID NO: 50976 - protein, 296 aa, Homo sapiens
  Payload ID: 10176
  Gene Symbol: MMADHC
  Gene Name: methylmalonic aciduria (cobalamin deficiency) cblD type, with homocystinuria
  Uniprot ID: Q9H3L0
  ENSP ID: ENSP00000301920
MANVLCNRARLVSYLPGFCSLVKRVVNPKAFSTAGSSGSDESHVAAAPPDICSRTVWPDETMGPFGPQDQRFQLPGNIGFDCHLNGTASQKKSLVHKTLPDVLAEPLSSERHEFVMAQYVNEFQGNDAPVEQEINSAETYFESARVECAIQTCPELLRKDFESLFPEVANGKLMILTVTQKTKNDMTVWSEEVEIEREVLLEKFINGAKEICYALRAEGYWADFIDPSSGLAFFGPYTNNTLFETDERYRHLGFSVDDLGCCKVIRHSLWGTHVVVGSIFTNATPDSHIMKKLSGN

SEQ ID NO: 50977 - protein, 296 aa, Homo sapiens; identical to SEQ ID NO: 50976
  Payload ID: 10176
  Gene Symbol: MMADHC
  Gene Name: methylmalonic aciduria (cobalamin deficiency) cblD type, with homocystinuria
  Uniprot ID: Q9H3L0
  ENSP ID: ENSP00000389060

SEQ ID NO: 50978 - protein, 330 aa, Homo sapiens
  Payload ID: 10176
  Gene Symbol: MMADHC
  Gene Name: methylmalonic aciduria (cobalamin deficiency) cblD type, with homocystinuria
  ENSP ID: ENSP00000408331
MANVLCNRARLVSYLPGFCSLVKRVVNPKAFSTAGSSGSDESHVAAAPPDICSRTVWPDETMGPFGPQDQRFQLPGNIGFDCHLNGTASQKKSLVHKTLPDVLAEPLSSERHEFVMAQYVNEFQGNDAPVEQEINSAETYFESARVECAIQTCPELLRKDFESLFPEVANGKLMILTVTQKTKNDMTVWSEEVEIEREVLLEKTESLSPRPECCGMISAHCNLCLPGSSNSSASASRFINGAKEICYALRAEGYWADFIDPSSGLAFFGPYTNNTLFETDERYRHLGFSVDDLGCCKVIRHSLWGTHVVVGSIFTNATPDSHIMKKLSGN

SEQ ID NO: 50979 - protein, 176 aa, Homo sapiens
  Payload ID: 10177
  Gene Symbol: MCEE
  Gene Name: methylmalonyl CoA epimerase
  Uniprot ID: Q96PE7
  ENSP ID: ENSP00000244217
MARVLKAAAANAVGLFSRLQAPIPTVRASSTSQPLDQVTGSVWNLGRLNHVAIAVPDLEKAAAFYKNILGAQVSEAVPLPEHGVSVVFVNLGNTKMELLHPLGRDSPIAGFLQKNKAGGMHHICIEVDNINAAVMDLKKKKIRSLSEEVKIGAHGKPVIFLHPKDCGGVLVELEQA

SEQ ID NO: 50980 - protein, 78 aa, Homo sapiens
  Payload ID: 10177
  Gene Symbol: MCEE
  Gene Name: methylmalonyl CoA epimerase
  ENSP ID: ENSP00000391140
LGRLNHVAIAVPDLEKAAAFYKNILGAQVDNINAAVMDLKKKKIRSLSEEVKIGAHGKPVIFLHPKDCGGVLVELEQA

SEQ ID NO: 50981 - protein, 31 aa, Homo sapiens
  Payload ID: 10177
  Gene Symbol: MCEE
  Gene Name: methylmalonyl CoA epimerase
  ENSP ID: ENSP00000437361
MELLHPLGRDSPIAGFLQKNKAGGMHHICIE

SEQ ID NO: 50982 - protein, 31 aa, Homo sapiens; identical to SEQ ID NO: 50981
  Payload ID: 10177
  Gene Symbol: MCEE
  Gene Name: methylmalonyl CoA epimerase
  ENSP ID: ENSP00000441569

SEQ ID NO: 50983 - protein, 750 aa, Homo sapiens
  Payload ID: 10178
  Gene Symbol: MUT
  Gene Name: methylmalonyl CoA mutase
  Uniprot ID: P22033
  ENSP ID: ENSP00000274813
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAERCLAALTECAASGDGNILALAVDASRARCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGISTLAAGHKTLVPELIKELNSLGRPDILVMCGGVIPPQDYEFLFEVGVSNVFGPGTRIPKAAVQVLDDIEKCLEKKQQSV

SEQ ID NO: 50984 - protein, 689 aa, Homo sapiens
  Payload ID: 10179
  Gene Symbol: MEPCE
  Gene Name: methylphosphate capping enzyme
  Uniprot ID: Q7L2J0
  ENSP ID: ENSP00000308546
MIEMAAEKEPFLVPAPPPPLKDESGGGGGPTVPPHQEAASGELRGGTERGPGRCAPSAGSPAAAVGRESPGAAATSSSGPQAQQHRGGGPQAQSHGEARLSDPPGRAAPPDVGEERRGGGGTELGPPAPPRPRNGYQPHRPPGGGGGKRRNSCNVGGGGGGFKHPAFKRRRRVNSDCDSVLPSNFLLGGNIFDPLNLNSLLDEEVSRTLNAETPKSSPLPAKGRDPVEILIPKDITDPLSLNTCTDEGHVVLASPLKTGRKRHRHRGQHHQQQQAAGGSESHPVPPTAPLTPLLHGEGASQQPRHRGQNRDAPQPYELNTAINCRDEVVSPLPSALQGPSGSLSAPPAASVISAPPSSSSRHRKRRRTSSKSEAGARGGGQGSKEKGRGSWGGRHHHHHPLPAAGFKKQQRKFQYGNYCKYYGYRNPSCEDGRLRVLKPEWFRGRDVLDLGCNVGHLTLSIACKWGPSRMVGLDIDSRLIHSARQNIRHYLSEELRLPPQTLEGDPGAEGEEGTTTVRKRSCFPASLTASRGPIAAPQVPLDGADTSVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGFQRPVYLFHKARSPSH

SEQ ID NO: 50985 - protein, 220 aa, Homo sapiens
  Payload ID: 10179
  Gene Symbol: MEPCE
  Gene Name: methylphosphate capping enzyme
  Uniprot ID: Q7L2J0
  ENSP ID: ENSP00000400875
MVGLDIDSRLIHSARQNIRHYLSEELRLPPQTLEGDPGAEGEEGTTTVRKRSCFPASLTASRGPIAAPQVPLDGADTSVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGFQRPVYLFHKARSPSH

SEQ ID NO: 50986 - protein, 293 aa, Homo sapiens
  Payload ID: 10180
  Gene Symbol: MSMO1
  Gene Name: methylsterol monooxygenase 1
  Uniprot ID: Q15800
  ENSP ID: ENSP00000261507
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHSGYDIPLNPLNLIPFYAGSRHHDFHHMNFIGNYASTFTWWDRIFGTDSQYNAYNEKRKKFEKKTE

SEQ ID NO: 50987 - protein, 162 aa, Homo sapiens
  Payload ID: 10180
  Gene Symbol: MSMO1
  Gene Name: methylsterol monooxygenase 1
  Uniprot ID: Q15800
  ENSP ID: ENSP00000377361
MPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHSGYDIPLNPLNLIPFYAGSRHHDFHHMNFIGNYASTFTWWDRIFGTDSQYNAYNEKRKKFEKKTE

SEQ ID NO: 50988 - protein, 229 aa, Homo sapiens
  Payload ID: 10180
  Gene Symbol: MSMO1
  Gene Name: methylsterol monooxygenase 1
  ENSP ID: ENSP00000423633
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHR

SEQ ID NO: 50989 - protein, 85 aa, Homo sapiens
  Payload ID: 10180
  Gene Symbol: MSMO1
  Gene Name: methylsterol monooxygenase 1
  ENSP ID: ENSP00000425112
MATNESVSIFSSASLAVEYVDSLLPENPLQEPFKNAWNYMLNNYTKFQIATWGSLIVHEALYFLFCLPGFLFQFIPYMKKYKIQK

SEQ ID NO: 50990 - protein, 220 aa, Homo sapiens
  Payload ID: 10180
  Gene Symbol: MSMO1
  Gene Name: methylsterol monooxygenase 1
  ENSP ID: ENSP00000425241
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIR

SEQ ID NO: 50991 - protein, 283 aa, Homo sapiens
  Payload ID: 10181
  Gene Symbol: MTAP
  Gene Name: methylthioadenosine phosphorylase
  Uniprot ID: Q13126
  ENSP ID: ENSP00000369519
MASGTTTTAVKIGIIGGTGLDDPEILEGRTEKYVDTPFGKPSDALILGKIKNVDCVLLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAVSVDRVLKTLKENANKAKSLLLTTIPQIGSTEWSETLHNLKNMAQFSVLLPRH

SEQ ID NO: 50992 - protein, 50 aa, Homo sapiens
  Payload ID: 10181
  Gene Symbol: MTAP
  Gene Name: methylthioadenosine phosphorylase
  ENSP ID: ENSP00000393507
MASGTTTTAVKIGIIGGTGLDDPEILEGRTEKYVDTPFGKVNIQLVETSI

SEQ ID NO: 50993 - protein, 300 aa, Homo sapiens
  Payload ID: 10181
  Gene Symbol: MTAP
  Gene Name: methylthioadenosine phosphorylase
  ENSP ID: ENSP00000461932
MRPARASLAAAGRDWGAALGTHLPREERIGIIGGTGLDDPEILEGRTEKYVDTPFGKPSDALILGKIKNVDCVLLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAVSVDRVLKTLKENANKAKSLLLTTIPQIGSTEWSETLHNLKNMAQFSVLLPRH

SEQ ID NO: 50994 - protein, 112 aa, Homo sapiens
  Payload ID: 10181
  Gene Symbol: MTAP
  Gene Name: methylthioadenosine phosphorylase
  ENSP ID: ENSP00000462082
ESFMFRTWGADVINMTTVPEVVLAKEAGICYASIAMATDYDCWKEHEEAMIKFQMILSEGYHPFNIQESPFYRGLLDFPSVGHGRGEILPLSPLDLAGYCFQQPMQPPCPDS

SEQ ID NO: 50995 - protein, 334 aa, Homo sapiens
  Payload ID: 10181
  Gene Symbol: MTAP
  Gene Name: methylthioadenosine phosphorylase
  Uniprot ID: Q13126
  ENSP ID: ENSP00000463424
MASGTTTTAVKIGIIGGTGLDDPEILEGRTEKYVDTPFGKPSDALILGKIKNVDCVLLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAVSVDRVLKTLKENANKAKSLLLTTIPQIGSTEWSETLHNLKMIKFQMILSEGYHPFNIQESPFYRGLLDFPSVGHGRGEILPLSPLDLAGYCFQQPMQPPCPDS

SEQ ID NO: 50996 - protein, 242 aa, Homo sapiens
  Payload ID: 10181
  Gene Symbol: MTAP
  Gene Name: methylthioadenosine phosphorylase
  ENSP ID: ENSP00000464616
MASGTTTTAVKIGIIGGTGLDDPEILEGRTEKYVDTPFGKPSDALILGKIKNVDCVLLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEACYCFSRFRWTGS

SEQ ID NO: 50997 - protein, 369 aa, Homo sapiens
  Payload ID: 10182
  Gene Symbol: MRI1
  Gene Name: methylthioribose-1-phosphate isomerase 1
  Uniprot ID: Q9BV20
  ENSP ID: ENSP00000040663
MTLEAIRYSRGSLQILDQLLLPKQSRYEAVGSVHQAWEAIRAMKVRGAPAIALVGCLSLAVELQAGAGGPGLAALVAFVRDKLSFLVTARPTAVNMARAARDLADVAAREAEREGATEEAVRERVICCTEDMLEKDLRDNRSIGDLGARHLLERVAPSGGKVTVLTHCNTGALATAGYGTALGVIRSLHSLGRLEHAFCTETRPYNQGARLTAFELVYEQIPATLITDSMVAAAMAHRGVSAVVVGADRVVANGDTANKVGTYQLAIVAKHHGIPFYVAAPSSSCDLRLETGKEIIIEERPGQELTDVNGVRIAAPGIGVWNPAFDVTPHDLITGGIITELGVFAPEELRTALTTTISSRDGTLDGPQM

SEQ ID NO: 50998 - protein, 322 aa, Homo sapiens
  Payload ID: 10182
  Gene Symbol: MRI1
  Gene Name: methylthioribose-1-phosphate isomerase 1
  Uniprot ID: Q9BV20
  ENSP ID: ENSP00000314871
MTLEAIRYSRGSLQILDQLLLPKQSRYEAVGSVHQAWEAIRAMKVRGAPAIALVGCLSLAVELQAGAGGPGLAALVAFVRDKLSFLVTARPTAVNMARAARDLADVAAREAEREGATEEAVRERRETELCEHWEEHTRQRELPLRGPLGGTVLETRPYNQGARLTAFELVYEQIPATLITDSMVAAAMAHRGVSAVVVGADRVVANGDTANKVGTYQLAIVAKHHGIPFYVAAPSSSCDLRLETGKEIIIEERPGQELTDVNGVRIAAPGIGVWNPAFDVTPHDLITGGIITELGVFAPEELRTALTTTISSRDGTLDGPQM

SEQ ID NO: 50999 - protein, 155 aa, Homo sapiens
  Payload ID: 10183
  Gene Symbol: METTL1
  Gene Name: methyltransferase like 1
  Uniprot ID: Q9UBP6
  ENSP ID: ENSP00000257848
MAAETRNVAGAEAPPPQKRYYRQRAHSNPMADHTLRYPVKPEEMDWSELYPEFFAPLTQNQSHDDPKDKKEKRAQAQVEFADIGCGYGGLLADKDVLPLPRPTFQADKAQVANHQSHPASRICLRAKSWGAGVYHNRCAGATRLDVHSFRRAPTV

SEQ ID NO: 51000 - protein, 276 aa, Homo sapiens
  Payload ID: 10183
  Gene Symbol: METTL1
  Gene Name: methyltransferase like 1
  Uniprot ID: Q9UBP6
  ENSP ID: ENSP00000314441
MAAETRNVAGAEAPPPQKRYYRQRAHSNPMADHTLRYPVKPEEMDWSELYPEFFAPLTQNQSHDDPKDKKEKRAQAQVEFADIGCGYGGLLVELSPLFPDTLILGLEIRVKVSDYVQDRIRALRAAPAGGFQNIACLRSNAMKHLPNFFYKGQLTKMFFLFPDPHFKRTKHKWRIISPTLLAEYAYVLRVGGLVYTITDVLELHDWMCTHFEEHPLFERVPLEDLSEDPVVGHLGTSTEEGKKVLRNGGKNFPAIFRRIQDPVLQAVTSQTSLPGH

SEQ ID NO: 51001 - protein, 63 aa, Homo sapiens
  Payload ID: 10183
  Gene Symbol: METTL1
  Gene Name: methyltransferase like 1
  ENSP ID: ENSP00000447838
  MOD_RES (1)..(1): Any amino acid
XPDPHFKRTKHKWRIISPTLLAEYAYVLRVGGDFAYAGAGVYHNRCAGATRLDVHSFRRAPTV

SEQ ID NO: 51002 - protein, 81 aa, Homo sapiens
  Payload ID: 10183
  Gene Symbol: METTL1
  Gene Name: methyltransferase like 1
  ENSP ID: ENSP00000447988
  MOD_RES (1)..(1): Any amino acid
XETRNVAGAEAPPPQKRYYRQRAHSNPMADHTLRYGTVTAVPRHTYSGSGDPGEGLRLCTRPDSGPTRSSCRWLPEHRLSP

SEQ ID NO: 51003 - protein, 36 aa, Homo sapiens
  Payload ID: 10183
  Gene Symbol: METTL1
  Gene Name: methyltransferase like 1
  ENSP ID: ENSP00000448342
MAAETRNVAGAEAPPPQKRYYRQRAHSNPMADHTLR

SEQ ID NO: 51004 - protein, 124 aa, Homo sapiens
  Payload ID: 10183
  Gene Symbol: METTL1
  Gene Name: methyltransferase like 1
  ENSP ID: ENSP00000449397
  MOD_RES (1)..(1): Any amino acid
XLRAAPAGGFQNIACLRSNAMKHLPNFFYKGQRTKHKWRIISPTLLAEYAYVLRVGGLVYTITDVLELHDWMCTHFEEHPLFERVPLEDLSEDPVVGHLGTSTEEGKKVLRNGGKNFPAIFRRI

SEQ ID NO: 51005 - protein, 291 aa, Homo sapiens
  Payload ID: 10184
  Gene Symbol: METTL10
  Gene Name: methyltransferase like 10
  Uniprot ID: Q5JPI9
  ENSP ID: ENSP00000357829
MSSGADGGGGAAVAARSDKGSPGEDGFVPSALGTREHWDAVYERELQTFREYGDTGEIWFGEESMNRLIRWMQKHKIPLDASVLDIGTGNGVFLVELAKFGFSNITGIDYSPSAIQLSGSIIEKEGLSNIKLKVEDFLNLSTQLSGFHICIDKGTFDAISLNPDNAIEKRKQYVKSLSRVLKVKGFFLITSCNWTKEELLNEFSEGWSTVAGFWLTAALTSWAQAIFSTSASRVGGTTGTHHHAWIIFVFLAETRFCHVVQAGLELLGSSDSPTWPPKVLGLYHARPSLAF

SEQ ID NO: 51006 - protein, 104 aa, Homo sapiens
  Payload ID: 10184
  Gene Symbol: METTL10
  Gene Name: methyltransferase like 10
  ENSP ID: ENSP00000450447
MSSGADGGGGAAVAARSDKGSPGEDGFVPSALGTREHWDAVYERELQTFREYGDTGEIWFGEESMNRLIRWMQKHKIPLDASVLDIGTGNGVFLVELVGKIWFL

SEQ ID NO: 51007 - protein, 104 aa, Homo sapiens; identical to SEQ ID NO: 51006
  Payload ID: 10184
  Gene Symbol: METTL10
  Gene Name: methyltransferase like 10
  ENSP ID: ENSP00000451190

SEQ ID NO: 51008 - protein, 31 aa, Homo sapiens
  Payload ID: 10184
  Gene Symbol: METTL10
  Gene Name: methyltransferase like 10
  ENSP ID: ENSP00000470332
  MOD_RES (1)..(1): Any amino acid
XFELLEELPTPKFSFGGRSGNSVAALVFQKM

SEQ ID NO: 51009 - protein, 191 aa, Homo sapiens
  Payload ID: 10184
  Gene Symbol: METTL10
  Gene Name: methyltransferase like 10
  ENSP ID: ENSP00000479554
MSSGADGGGGAAVAARSDKGSPGEDGFVPSALGTREHWDAVYERELQTFREYGDTGEIWFGEESMNRLIRWMQKHKIPLDASVLDIGTGNGVFLVELAKFGFSNITGIDYSPSAIQLSGSIIEKEGLSNIKLKVEDFLNLSTQLSGFHICIDKGTFDAISLNPDNAIEKRKQYVKSLSRVLKVKGFSNNVM

SEQ ID NO: 51010 - protein, 283 aa, Homo sapiens
  Payload ID: 10185
  Gene Symbol: METTL11B
  Gene Name: methyltransferase like 11B
  Uniprot ID: Q5VVY1
  ENSP ID: ENSP00000408058
MAHRGAHFAFRSRWQKTDDELCRHSMSFILHKAIRNDFFQSYLYLLEKIPLVKLYALTSQVINGEMQFYARAKLFYQEVPATEEGMMGNFIELSSPDIQASQKFLRKFVGGPGRAGTDCALDCGSGIGRVSKHVLLPVFNSVELVDMMESFLLEAQNYLQVKGDKVESYHCYSLQEFTPPFRRYDVIWIQWVSGHLTDKDLLAFLSRCRDGLKENGIIILKDNVAREGCILDLSDSSVTRDMDILRSLIRKSGLVVLGQEKQDGFPEQCIPVWMFALHSDRHS

SEQ ID NO: 51011 - protein, 240 aa, Homo sapiens
  Payload ID: 10186
  Gene Symbol: METTL12
  Gene Name: methyltransferase like 12
  Uniprot ID: A8MUP2
  ENSP ID: ENSP00000431287
MAALRRMLHLPSLMMGTCRPFAGSLADSCLADRCLWDRLHAQPRLGTVPTFDWFFGYDEVQGLLLPLLQEAQAASPLRVLDVGCGTSSLCTGLYTKSPHPVDVLGVDFSPVAVAHMNSLLEGGPGQTPLCPGHPASSLHFMHADAQNLGAVASSGSFQLLLDKGTWDAVARGGLPRAYQLLSECLRVLNPQGTLIQFSDEDPDVRLPCLEQGSYGWTVTVQELGPFRGITYFAYLIQGSH

SEQ ID NO: 51012 - protein, 699 aa, Homo sapiens
  Payload ID: 10187
  Gene Symbol: METTL13
  Gene Name: methyltransferase like 13
  Uniprot ID: Q8N6R0
  ENSP ID: ENSP00000354920
MNLLPKSSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 51013 - protein, 613 aa, Homo sapiens
  Payload ID: 10187
  Gene Symbol: METTL13
  Gene Name: methyltransferase like 13
  Uniprot ID: Q8N6R0
  ENSP ID: ENSP00000355393
MKECNATRRPQMSFLKMDMTQMEFPDASFQVVLDKGTLDAVLTDEEEKTLQQVDRMLAEVGRVLQVGGRYLCISLAQAHILKKAVGHFSREGWMVRVHQVANSQDQVLEAEPQFSLPVFAFIMTKFRPVPGSALQIFELCAQEQRKPVRLESAERLAEAVQERQQYAWLCSQLRRKARLGSVSLDLCDGDTGEPRYTLHVVDSPTVKPSRDNHFAIFIIPQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 51014 - protein, 543 aa, Homo sapiens
  Payload ID: 10187
  Gene Symbol: METTL13
  Gene Name: methyltransferase like 13
  Uniprot ID: Q8N6R0
  ENSP ID: ENSP00000356711
MNLLPKSSREFGSVDYWEKFFQQRGKKAFEWYGTYLELCGVLHKYIKPREKVLVIGCGNSELSEQLYDVGYRDIVNIDISEVVIKQMKECNATRRPQMSFLKMDMTQMEFPDASFQVVLDKGTLDAVLTDEEEKTLQQVDRMLAEVGRVLQGRETEWLFGMDEGRKQLAASAGFRRLITVALHRGQQYESMDHIQAELSARVMELAPAGMPTQQQVPFLSVGGDIGVRTVQHQDCSPLSGDYVIEDVQGDDKRYFRRLIFLSNRNVVQSEARLLKDVSHKAQKKRKKDRKKQRPADAEDLPAAPGQSIDKSYLCCEHHKAMIAGLALLRNPELLLEIPLALLVVGLGGGSLPLFVHDHFPKSCIDAVEIDPSMLEVATQWFGFSQSDRMKVHIADGLDYIASLAGGGEARPCYDVIMFDVDSKDPTLGMSCPPPAFVEQSFLQKVKSILTPEGVFILNLVCRDLGLKDSVLAGLKAVFPLLYVRRIEGEVNEILFCQLHPEQKLATPELLETAQALERTLRKPGRGWDDTYVLSDMLKTVKIV

SEQ ID NO: 51015 - protein, 456 aa, Homo sapiens
  Payload ID: 10188
  Gene Symbol: METTL14
  Gene Name: methyltransferase like 14
  Uniprot ID: Q9HCE5
  ENSP ID: ENSP00000373474
MDSRLQEIRERQKLRRQLLAQQLGAESADSIGAVLNSKDEQREIAETRETCRASYDTSAPNAKRKYLDEGETDEDKMEEYKDELEMQQDEENLPYEEEIYKDSSTFLKGTQSLNPHNDYCQHFVDTGHRPQNFIRDVGLADRFEEYPKLRELIRLKDELIAKSNTPPMYLQADIEAFDIRELTPKFDVILLEPPLEEYYRETGITANEKCWTWDDIMKLEIDEIAAPRSFIFLWCGSGEGLDLGRVCLRKWGYRRCEDICWIKTNKNNPGKTKTLDPKAVFQRTKEHCLMGIKGTVKRSTDGDFIHANVDIDLIITEEPEIGNIEKPVEIFHIIEHFCLGRRRLHLFGRDSTIRPGWLTVGPTLTNSNYNAETYASYFSAPNSYLTGCTEEIERLRPKSPPPKSKSDRGGGAPRGGGRGGTSAGRGRERNRSNFRGERGGFRGGRGGAHRGGFPPR

SEQ ID NO: 51016 - protein, 137 aa, Homo sapiens
  Payload ID: 10188
  Gene Symbol: METTL14
  Gene Name: methyltransferase like 14
  ENSP ID: ENSP00000424111
  MOD_RES (1)..(1): Any amino acid
XIRELTPKFDVILLEPPLEEYYRETGITANEKCWTWDDIMKLEIDEIAAPRSFIFLWCGSGEGLDLGRVCLRKWGYRRCEDICWIKTNKNNPGKTKTLDPKAVFQRTKAGSQLDQRLQIATTMQKHMHPISVLLIPT

SEQ ID NO: 51017 - protein, 121 aa, Homo sapiens
  Payload ID: 10188
  Gene Symbol: METTL14
  Gene Name: methyltransferase like 14
  ENSP ID: ENSP00000425460
MDSRLQEIRERQKLRRQLLAQQICGIWLKPWKLGVRFVPLFLIPLALRSWANQVSFLSLLFANFFYRIIFKNLGAESADSIGAVLNSKDEQREIAETRETCRASYDTSAPNAKRKYLDEGE

SEQ ID NO: 51018 - protein, 64 aa, Homo sapiens
  Payload ID: 10188
  Gene Symbol: METTL14
  Gene Name: methyltransferase like 14
  ENSP ID: ENSP00000486381
MDSRLQEIRERQKLRRQLLAQQLGAESADSIGAVLNSKDEQREIAETRETCRASYDTSAPNAKR

SEQ ID NO: 51019 - protein, 89 aa, Homo sapiens
  Payload ID: 10188
  Gene Symbol: METTL14
  Gene Name: methyltransferase like 14
  ENSP ID: ENSP00000486933
MDSRLQEIRERQKLRRQLLAQQLGAESADSIGAVLNSKDEQREIAETRETCRASYDTSAPNAKRKYLDEGETDEDKMEEYKASRENATG

SEQ ID NO: 51020 - protein, 273 aa, Homo sapiens
  Payload ID: 10189
  Gene Symbol: METTL15
  Gene Name: methyltransferase like 15
  Uniprot ID: A6NJ78
  ENSP ID: ENSP00000307251
MLRYPYFCRMYKECLSCWLESGIPNLGVWPNRIHTTAEKYREYEAREQTDQTQAQELHRSQDRDFETMAKLHIPVMVDEVVHCLSPQKGQIFLDMTFGSGGHTKAILQKESDIVLYALDRDPTAYALAEHLSELYPKQIRAMLGQFSQAEALLMKAGVQPGTFDGVLMDLGCSSMQLDTPERGFSLRKDGPLDMRMDGGRYPDMPTAADVVNALDQQALASILRTYGEEKHAKKIASAIVQARSIYPITRTQQLASIVAEYSETYFPVAQTLY

SEQ ID NO: 51021 - protein, 407 aa, Homo sapiens
  Payload ID: 10189
  Gene Symbol: METTL15
  Gene Name: methyltransferase like 15
  Uniprot ID: A6NJ78
  ENSP ID: ENSP00000384369
MLRYPYFCRMYKECLSCWLESGIPNLGVWPNRIHTTAEKYREYEAREQTDQTQAQELHRSQDRDFETMAKLHIPVMVDEVVHCLSPQKGQIFLDMTFGSGGHTKAILQKESDIVLYALDRDPTAYALAEHLSELYPKQIRAMLGQFSQAEALLMKAGVQPGTFDGVLMDLGCSSMQLDTPERGFSLRKDGPLDMRMDGGRYPDMPTAADVVNALDQQALASILRTYGEEKHAKKIASAIVQARSIYPITRTQQLASIVAGAFPPSAIYTRKDLLQRSTHIATKTFQALRIFVNNELNELYTGLKTAQKFLRPGGRLVALSFHSLEDRIVKRFLLGISMTERFNLSVRQQVMKTSQLGSDHENTEEVSMRRAPLMWELIHKKVLSPQDQDVQDNPRGRSAKLRAAIKL

SEQ ID NO: 51022 - protein, 279 aa, Homo sapiens
  Payload ID: 10189
  Gene Symbol: METTL15
  Gene Name: methyltransferase like 15
  Uniprot ID: A6NJ78
  ENSP ID: ENSP00000385507
MLRYPYFCRMYKECLSCWLESGIPNLGVWPNRIHTTAEKYREYEAREQTDQTQAQELHRSQDRDFETMAKLHIPVMVDEVVHCLSPQKGQIFLDMTFGSGGHTKAILQKESDIVLYALDRDPTAYALAEHLSELYPKQIRAMLGQFSQAEALLMKAGVQPGTFDGVLMDLGCSSMQLDTPERGFSLRKDGPLDMRMDGGRSTGTCIYPKNIRGGEACQENRFSNCSGTQHLPHHQNPAACQHRCRSISSLCYLYTERLTTAIYPYCHQDFPGSSHICEQ

SEQ ID NO: 51023 - protein, 93 aa, Homo sapiens
  Payload ID: 10189
  Gene Symbol: METTL15
  Gene Name: methyltransferase like 15
  ENSP ID: ENSP00000385860
MLRYPYFCRMYKECLSCWLESGIPNLGVWPNRIHTTAEKYREYEAREQTDQTQAQELHRSQDRDFETMAKLHIPVMVDEVVHCLSPQKGQQKK

SEQ ID NO: 51024 - protein, 99 aa, Homo sapiens
  Payload ID: 10189
  Gene Symbol: METTL15
  Gene Name: methyltransferase like 15
  Uniprot ID: A6NJ78
  ENSP ID: ENSP00000392806
MLRYPYFCRMYKECLSCWLESGIPNLGVWPNRIHTTAEKYREYEAREQTDQTQAQELHRSQDRDFETMAKLHIPVMVDEVVHCLSPQKGQSLGVRSVGI

SEQ ID NO: 51025 - protein, 164 aa, Homo sapiens
  Payload ID: 10189
  Gene Symbol: METTL15
  Gene Name: methyltransferase like 15
  ENSP ID: ENSP00000396550
MLRYPYFCRMYKECLSCWLESGIPNLGVWPNRIHTTAEKYREYEAREQTDQTQAQELHRSQDRDFETMAKLHIPVMVDEVVHCLSPQKGQILFMCIVLFAYPNFLVMWTRMVYLFPFTHEETEAQRNFSRYDIWFGRAHKSHSAEGVRYCSLCLGQRPNSLCIS

SEQ ID NO: 51026 - protein, 107 aa, Homo sapiens
  Payload ID: 10189
  Gene Symbol: METTL15
  Gene Name: methyltransferase like 15
  ENSP ID: ENSP00000489363
MLRYPYFCRMYKECLSCWLESGIPNLGVWPNRIHTTAEKYREYEAREQTDQTQAQELHRSQDRDFETMAKLHIPVMVDEVVHCLSPQKGQQLLLRKSGRRPLLTASC

SEQ ID NO: 51027 - protein, 274 aa, Homo sapiens
  Payload ID: 10189
  Gene Symbol: METTL15
  Gene Name: methyltransferase like 15
  ENSP ID: ENSP00000489381
MLRYPYFCRMYKECLSCWLESGIPNLGVWPNRIHTTAEKYREYEAREQTDQTQAQELHRSQDRDFETMAKLHIPVMVDEVVHCLSPQKGQIFLDMTFGSGGHTKAILQKESDIVLYALDRDPTAYALAEHLSELYPKQIRAMLGQFSQAEALLMKAGVQPGTFDGVLMDLGCSSMQLDTPERGFSLRKDGPLDMRMDGGRYPDMPTAADVVNALDQQALASILRTYGEEKHAKKIASAIVQARSIYPITRTQQLASIVAGCTGESKLFWRCPKA

SEQ ID NO: 51028 - protein, 149 aa, Homo sapiens
  Payload ID: 10189
  Gene Symbol: METTL15
  Gene Name: methyltransferase like 15
  ENSP ID: ENSP00000489468
MLRYPYFCRMYKECLSCWLESGIPNLGVWPNRIHTTAEKYREYEAREQTDQTQAQELHRSQDRDFETMAKLHIPVMVDEVVHCLSPQKGQNSVRLHGLFPMCSSFCTCYQNFILQQPCFCCHLKSVPNFSSCNSLPMLLLGYLILHRSF

SEQ ID NO: 51029 - protein, 90 aa, Homo sapiens
  Payload ID: 10189
  Gene Symbol: METTL15
  Gene Name: methyltransferase like 15
  ENSP ID: ENSP00000489497
MLRYPYFCRMYKECLSCWLESGIPNLGVWPNRIHTTAEKYREYEAREQTDQTQAQELHRSQDRDFETMAKLHIPVMVDEVVHCLSPQKGQ

SEQ ID NO: 51030 - protein, 274 aa, Homo sapiens; identical to SEQ ID NO: 51027
  Payload ID: 10189
  Gene Symbol: METTL15
  Gene Name: methyltransferase like 15
  ENSP ID: ENSP00000489505

SEQ ID NO: 51031 - protein, 562 aa, Homo sapiens
  Payload ID: 10190
  Gene Symbol: METTL16
  Gene Name: methyltransferase like 16
  Uniprot ID: Q86W50
  ENSP ID: ENSP00000263092
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIGTGASCIYPLLGATLNGWYFLATEVDDMCFNYAKKNVEQNNLSDLIKVVKVPQKTLLMDALKEESEIIYDFCMCNPPFFANQLEAKGVNSRNPRRPPPSSVNTGGITEIMAEGGELEFVKRIIHDSLQLKKRLRWYSCMLGKKCSLAPLKEELRIQGVPKVTYTEFCQGRTMRWALAWSFYDDVTVPSPPSKRRKLEKPRKPITFVVLASVMKELSLKASPLRSETAEGIVVVTTWIEKILTDLKVQHKRVPCGKEEVSLFLTAIENSWIHLRRKKRERVRQLREVPRAPEDVIQALEEKKPTPKESGNSQELARGPQERTPCGPALREGEAAAVEGPCPSQESLSQEENPEPTEDERSEEKGGVEVLESCQGSSNGAQDQEASEQFGSPVAERGKRLPGVAGQYLFKCLINVKKEVDDALVEMHWVEGQNRDLMNQLCTYIRNQIFRLVAVN

SEQ ID NO: 51032 - protein, 168 aa, Homo sapiens
  Payload ID: 10190
  Gene Symbol: METTL16
  Gene Name: methyltransferase like 16
  ENSP ID: ENSP00000460207
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIGTGASCIYPLLGATLNGWYFLATEVDDMCFNYAKKNVEQNNLSDLIKGSKLTKSSKTSA

SEQ ID NO: 51033 - protein, 121 aa, Homo sapiens
  Payload ID: 10190
  Gene Symbol: METTL16
  Gene Name: methyltransferase like 16
  ENSP ID: ENSP00000460775
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIGSKLTKSSKTSA

SEQ ID NO: 51034 - protein, 148 aa, Homo sapiens
  Payload ID: 10190
  Gene Symbol: METTL16
  Gene Name: methyltransferase like 16
  ENSP ID: ENSP00000461546
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIVVKVPQKTLLMDALKEESEIIYDFCMCNPPFFANQLEAK

SEQ ID NO: 51035 - protein, 101 aa, Homo sapiens
  Payload ID: 10190
  Gene Symbol: METTL16
  Gene Name: methyltransferase like 16
  ENSP ID: ENSP00000465733
  MOD_RES (1)..(1): Any amino acid
XLNFKDPEAVRALTCTLLREDFGLSIDIPLERLIPTVPLRLNYIHWVEDLIGHQDSDKSTLRRGIDIGIQGRACPVALGPGYPRAKMARGHLASTPYLEQP

SEQ ID NO: 51036 - protein, 456 aa, Homo sapiens
  Payload ID: 10191
  Gene Symbol: METTL17
  Gene Name: methyltransferase like 17
  Uniprot ID: Q9H7H0
  ENSP ID: ENSP00000343041
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRDLYRCARVSSWGDLLPVLTPSAFPPSTAQDPSES

SEQ ID NO: 51037 - protein, 478 aa, Homo sapiens
  Payload ID: 10191
  Gene Symbol: METTL17
  Gene Name: methyltransferase like 17
  Uniprot ID: Q9H7H0
  ENSP ID: ENSP00000372445
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRYGGCDQNQWDVAGSCSPRQHLFPQGFVSLCPCQLLGRSFTCAYSVCVSSIYGSGSL

SEQ ID NO: 51038 - protein, 158 aa, Homo sapiens
  Payload ID: 10191
  Gene Symbol: METTL17
  Gene Name: methyltransferase like 17
  ENSP ID: ENSP00000450782
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPGPDFQSLFSPQTYLRQRRNFVEQCYTHYVKLPTIGKN

SEQ ID NO: 51039 - protein, 447 aa, Homo sapiens
  Payload ID: 10191
  Gene Symbol: METTL17
  Gene Name: methyltransferase like 17
  Uniprot ID: Q9H7H0
  ENSP ID: ENSP00000450794
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGSSWGDLLPVLTPSAFPPSTAQDPSES

SEQ ID NO: 51040 - protein, 158 aa, Homo sapiens; identical to SEQ ID NO: 51038
  Payload ID: 10191
  Gene Symbol: METTL17
  Gene Name: methyltransferase like 17
  ENSP ID: ENSP00000450948

SEQ ID NO: 51041 - protein, 174 aa, Homo sapiens
  Payload ID: 10191
  Gene Symbol: METTL17
  Gene Name: methyltransferase like 17
  ENSP ID: ENSP00000451049
MENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPK

SEQ ID NO: 51042 - protein, 140 aa, Homo sapiens
  Payload ID: 10191
  Gene Symbol: METTL17
  Gene Name: methyltransferase like 17
  ENSP ID: ENSP00000451478
MENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAA

SEQ ID NO: 51043 - protein, 186 aa, Homo sapiens
  Payload ID: 10191
  Gene Symbol: METTL17
  Gene Name: methyltransferase like 17
  ENSP ID: ENSP00000451804
MVPRPWSGSPGPGECLHSLLSERLWICRDISAQRRSAPGSPRPSDCQQLSFLPGNQPTFLCLQALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQEL

SEQ ID NO: 51044 - protein, 102 aa, Homo sapiens
  Payload ID: 10191
  Gene Symbol: METTL17
  Gene Name: methyltransferase like 17
  ENSP ID: ENSP00000451913
MENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAF

SEQ ID NO: 51045 - protein, 123 aa, Homo sapiens
  Payload ID: 10191
  Gene Symbol: METTL17
  Gene Name: methyltransferase like 17
  ENSP ID: ENSP00000452238
  MOD_RES (1)..(1): Any amino acid
XPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGSSWGDLLPVLTPSAFPPSTAQDPSES

SEQ ID NO: 51046 - protein, 158 aa, Homo sapiens; identical to SEQ ID NO: 51038
  Payload ID: 10191
  Gene Symbol: METTL17
  Gene Name: methyltransferase like 17
  ENSP ID: ENSP00000452392

SEQ ID NO: 51047 - protein, 372 aa, Homo sapiens
  Payload ID: 10192
  Gene Symbol: METTL18
  Gene Name: methyltransferase like 18
  Uniprot ID: O95568
  ENSP ID: ENSP00000307077
MTFQFNFTIEDHLENELTPIRDGALTLDSSKELSVSESQKGEERDRKCSAEQFDLPQDHLWEHKSMENAAPSQDTDSPLSAASSSRNLEPHGKQPSLRAAKEHAMPKDLKKMLENKVIETLPGFQHVKLSVVKTILLKENFPGENIVSKSFSSHSDLITGVYEGGLKIWECTFDLLAYFTKAKVKFAGKKVLDLGCGSGLLGITAFKGGSKEIHFQDYNSMVIDEVTLPNVVANSTLEDEENDVNEPDVKRCRKPKVTQLYKCRFFSGEWSEFCKLVLSSEKLFVKYDLILTSETIYNPDYYSNLHQTFLRLLSKNGRVLLASKAHYFGVGGGVHLFQKFVEERDVFKTRILKIIDEGLKRFIIEITFKFPG

SEQ ID NO: 51048 - protein, 372 aa, Homo sapiens; identical to SEQ ID NO: 51047
  Payload ID: 10192
  Gene Symbol: METTL18
  Gene Name: methyltransferase like 18
  Uniprot ID: O95568
  ENSP ID: ENSP00000307975

SEQ ID NO: 51049 - protein, 184 aa, Homo sapiens
  Payload ID: 10192
  Gene Symbol: METTL18
  Gene Name: methyltransferase like 18
  ENSP ID: ENSP00000402305
MTFQFNFTIEDHLENELTPIRDGALTLDSSKELSVSESQKGEERDRKCSAEQFDLPQDHLWEHKSMENAAPSQDTDSPLSAASSSRNLEPHGKQPSLRAAKEHAMPKDLKKMLENKVIETLPGFQHVKLSVVKTILLKENFPGENIVSKSFSSHSDLITGVYEGGLKIWECTFDLLAYFTKAKV

SEQ ID NO: 51050 - protein, 262 aa, Homo sapiens
  Payload ID: 10193
  Gene Symbol: METTL20
  Gene Name: methyltransferase like 20
  Uniprot ID: Q8IXQ9
  ENSP ID: ENSP00000350353
MALSLGWKAHRNHCGLLLQALRSSGLLLFPCGQCPWRGAGSFLDPEIKAFLEENTEVTSSGSLTPEIQLRLLTPRCKFWWERADLWPHSDPYWAIYWPGGQALSRYLLDNPDVVRGKSVLDLGSGCGATAIAAKMSGASRILANDIDPIAGMAITLNCELNRLNPFPILIQNILNLEQDKWDLVVLGDMFYDEDLADSLHQWLKKCFWTYRTRVLIGDPGRPQFSGHSIQHHLHKVVEYSLLESTRQENSGLTTSTVWGFQP

SEQ ID NO: 51051 - protein, 262 aa, Homo sapiens; identical to SEQ ID NO: 51050
  Payload ID: 10193
  Gene Symbol: METTL20
  Gene Name: methyltransferase like 20
  Uniprot ID: Q8IXQ9
  ENSP ID: ENSP00000379112

SEQ ID NO: 51052 - protein, 262 aa, Homo sapiens; identical to SEQ ID NO: 51050
  Payload ID: 10193
  Gene Symbol: METTL20
  Gene Name: methyltransferase like 20
  Uniprot ID: Q8IXQ9
  ENSP ID: ENSP00000396123

SEQ ID NO: 51053 - protein, 114 aa, Homo sapiens
  Payload ID: 10193
  Gene Symbol: METTL20
  Gene Name: methyltransferase like 20
  ENSP ID: ENSP00000437442
MALSLGWKAHRNHCGLLLQALRSSGLLLFPCGQCPWRGAGSFLDPEIKAFLEENTEVTSSGSLTPEIQLRLLTPRCKFWWERADLWPHSDPYWAIYWPGGQALSSCRNGYYTKL

SEQ ID NO: 51054 - protein, 262 aa, Homo sapiens; identical to SEQ ID NO: 51050
  Payload ID: 10193
  Gene Symbol: METTL20
  Gene Name: methyltransferase like 20
  Uniprot ID: Q8IXQ9
  ENSP ID: ENSP00000441421

SEQ ID NO: 51055 - protein, 72 aa, Homo sapiens
  Payload ID: 10193
  Gene Symbol: METTL20
  Gene Name: methyltransferase like 20
  ENSP ID: ENSP00000445165
MALSLGWKAHRNHCGLLLQALRSSGLLLFPCGQCPWRGAGSFLDPEIKAFLEENTEVTSSGSLTPEIQLRLL

SEQ ID NO: 51056 - protein, 236 aa, Homo sapiens
  Payload ID: 10194
  Gene Symbol: METTL21A
  Gene Name: methyltransferase like 21A
  ENSP ID: ENSP00000272839
MALVPYEETTEFGLQKFHKPLATFSFANHTIQIRQDWRHLGVAAVVWDAAIVLSTYLEMGAVELRGRSAVELGAGTGLVGIVAALLALKSSMKPLLVHCLLFFSGAHVTITDRKVALEFLKSNVQANLPPHIQTKTVVKELTWGQNLGSFSPGEFDLILGADIIYLEETFTDLLQTLEHLCSNHSVILLACRIRYERDNNFLAMLERQFTVRKVHYDPEKDVHIYEAQKRNQKEDL

SEQ ID NO: 51057 - protein, 218 aa, Homo sapiens
  Payload ID: 10194
  Gene Symbol: METTL21A
  Gene Name: methyltransferase like 21A
  Uniprot ID: Q8WXB1
  ENSP ID: ENSP00000385481
MALVPYEETTEFGLQKFHKPLATFSFANHTIQIRQDWRHLGVAAVVWDAAIVLSTYLEMGAVELRGRSAVELGAGTGLVGIVAALLGAHVTITDRKVALEFLKSNVQANLPPHIQTKTVVKELTWGQNLGSFSPGEFDLILGADIIYLEETFTDLLQTLEHLCSNHSVILLACRIRYERDNNFLAMLERQFTVRKVHYDPEKDVHIYEAQKRNQKEDL

SEQ ID NO: 51058 - protein, 90 aa, Homo sapiens
  Payload ID: 10194
  Gene Symbol: METTL21A
  Gene Name: methyltransferase like 21A
  Uniprot ID: Q8WXB1
  ENSP ID: ENSP00000389684
MALVPYEETTEFGLQKFHKPLATFSFANHTIQIRQDWRHLGVAAVVWDAAIVLSTYLEMGAVELRGRSAVELGAGTGLVGIVAALLGGGI

SEQ ID NO: 51059 - protein, 218 aa, Homo sapiens; identical to SEQ ID NO: 51057
  Payload ID: 10194
  Gene Symbol: METTL21A
  Gene Name: methyltransferase like 21A
  Uniprot ID: Q8WXB1
  ENSP ID: ENSP00000392062

SEQ ID NO: 51060 - protein, 90 aa, Homo sapiens; identical to SEQ ID NO: 51058
  Payload ID: 10194
  Gene Symbol: METTL21A
  Gene Name: methyltransferase like 21A
  Uniprot ID: Q8WXB1
  ENSP ID: ENSP00000400730

SEQ ID NO: 51061 - protein, 218 aa, Homo sapiens; identical to SEQ ID NO: 51057
  Payload ID: 10194
  Gene Symbol: METTL21A
  Gene Name: methyltransferase like 21A
  Uniprot ID: Q8WXB1
  ENSP ID: ENSP00000403317

SEQ ID NO: 51062 - protein, 218 aa, Homo sapiens; identical to SEQ ID NO: 51057
  Payload ID: 10194
  Gene Symbol: METTL21A
  Gene Name: methyltransferase like 21A
  Uniprot ID: Q8WXB1
  ENSP ID: ENSP00000407622

SEQ ID NO: 51063 - protein, 52 aa, Homo sapiens
  Payload ID: 10194
  Gene Symbol: METTL21A
  Gene Name: methyltransferase like 21A
  ENSP ID: ENSP00000409485
MALVPYEETTEFGLQKFHKPLATFSFANHTIQIRQDWRHLGVAAVVWDAVLM

SEQ ID NO: 51064 - protein, 218 aa, Homo sapiens; identical to SEQ ID NO: 51057
  Payload ID: 10194
  Gene Symbol: METTL21A
  Gene Name: methyltransferase like 21A
  Uniprot ID: Q8WXB1
  ENSP ID: ENSP00000415115

SEQ ID NO: 51065 - protein, 127 aa, Homo sapiens
  Payload ID: 10194
  Gene Symbol: METTL21A
  Gene Name: methyltransferase like 21A
  ENSP ID: ENSP00000416570
MALVPYEETTEFGLQKFHKPLATFSFANHTIQIRQDWRHLGVAAVVWDAAIVLSTYLEMGAVELRGRSAVELGAGTGLVGIVAALLENTGQMQTEGYSKRKQITTLQKLQGHQRQGNKLSQTEGDYN

SEQ ID NO: 51066 - protein, 226 aa, Homo sapiens
  Payload ID: 10195
  Gene Symbol: METTL21B
  Gene Name: methyltransferase like 21B
  Uniprot ID: Q96AZ1
  ENSP ID: ENSP00000300209
MADPGPDPESESESVFPREVGLFADSYSEKSQFCFCGHVLTITQNFGSRLGVAARVWDAALSLCNYFESQNVDFRGKKVIELGAGTGIVGILAALQGGDVTITDLPLALEQIQGNVQANVPAGGQAQVRALSWGIDHHVFPANYDLVLGADIVYLEPTFPLLLGTLQHLCRPHGTIYLASKMRKEHGTESFFQHLLPQHFQLELAQRDEDENVNIYRARHREPRPA

SEQ ID NO: 51067 - protein, 149 aa, Homo sapiens
  Payload ID: 10195
  Gene Symbol: METTL21B
  Gene Name: methyltransferase like 21B
  Uniprot ID: Q96AZ1
  ENSP ID: ENSP00000327425
MADPGPDPESESESVFPREVGLFADSYSEKSQFCFCGHVLTITQNFGSRLGVAARVWDAALSLCNYFESQNVDFRGKKVIELGAGTGIVGILAALQGAYGLVRETEDDVIEQELWRGMRGACGHALSMSTMTPWESIKGSSVRGGCYHH

SEQ ID NO: 51068 - protein, 107 aa, Homo sapiens
  Payload ID: 10195
  Gene Symbol: METTL21B
  Gene Name: methyltransferase like 21B
  ENSP ID: ENSP00000447718
MHWDPTLCLCSAGREGKALSLCNYFESQNVDFRGKKVIELGAGTGIVGILAALQGAYGLVRETEDDVIEQELWRGMRGACGHALSMSTMTPWESIKGSSVRGGCYHH

SEQ ID NO: 51069 - protein, 45 aa, Homo sapiens
  Payload ID: 10195
  Gene Symbol: METTL21B
  Gene Name: methyltransferase like 21B
  ENSP ID: ENSP00000448163
MRKEHGTESFFQHLLPQHFQLELAQRDEDENVNIYRARHREPRPA

SEQ ID NO: 51070 - protein, 10 aa, Homo sapiens
  Payload ID: 10195
  Gene Symbol: METTL21B
  Gene Name: methyltransferase like 21B
  ENSP ID: ENSP00000487543
SNPFTNHTTR

SEQ ID NO: 51071 - protein, 264 aa, Homo sapiens
  Payload ID: 10196
  Gene Symbol: METTL21C
  Gene Name: methyltransferase like 21C
  Uniprot ID: Q5VZV1
  ENSP ID: ENSP00000267273
MDVCLSSAQQPGRRGEGLSSPGGWLEAEKKGAPQKDSTGGVLEESNKIEPSLHSLQKFVPTDYASYTQEHYRFAGKEIVIQESIESYGAVVWPGAMALCQYLEEHAEELNFQDAKILEIGAGPGLVSIVASILGAQVTATDLPDVLGNLQYNLLKNTLQCTAHLPEVKELVWGEDLDKNFPKSAFYYDYVLASDVVYHHYFLDKLLTTMVYLSQPGTVLLWANKFRFSTDYEFLDKFKQVFDTTLLAEYPESSVKLFKGILKWD

SEQ ID NO: 51072 - protein, 205 aa, Homo sapiens
  Payload ID: 10197
  Gene Symbol: METTL22
  Gene Name: methyltransferase like 22
  Uniprot ID: Q9BUU2
  ENSP ID: ENSP00000163678
MVQLAPAAAMDEVTFRSDTVLSDVHLYTPNHRHLMVRLNSVGQPVFLSQFKLLWSQDSWTDSGAKGGSHRDVHTKEPPSAETGSTGSPPGSGHGNEGFSLQAGTDTTGQEVAEAQLDEDGDLDVVRRPRAASDSNPAGPLRDKVHPMILAQEEDDVLGEEAQGSPHDIIRIGVAGRPAPGRLHPVPTGPLPRMYSAGARGRHGAR

SEQ ID NO: 51073 - protein, 404 aa, Homo sapiens
  Payload ID: 10197
  Gene Symbol: METTL22
  Gene Name: methyltransferase like 22
  Uniprot ID: Q9BUU2
  ENSP ID: ENSP00000371345
MVQLAPAAAMDEVTFRSDTVLSDVHLYTPNHRHLMVRLNSVGQPVFLSQFKLLWSQDSWTDSGAKGGSHRDVHTKEPPSAETGSTGSPPGSGHGNEGFSLQAGTDTTGQEVAEAQLDEDGDLDVVRRPRAASDSNPAGPLRDKVHPMILAQEEDDVLGEEAQGSPHDIIRIEHTMATPLEDVGKQVWRGALLLADYILFRQDLFRGCTALELGAGTGLASIIAATMARTVYCTDVGADLLSMCQRNIALNSHLAATGGGIVRVKELDWLKDDLCTDPKVPFSWSQEEISDLYDHTTILFAAEVFYDDDLTDAVFKTLSRLAHRLKNACTAILSVEKRLNFTLRHLDVTCEAYDHFRSCLHALEQLADGKLRFVVEPVEASFPQLLVYERLQQLELWKIIAEPVT

SEQ ID NO: 51074 - protein, 16 aa, Homo sapiens
  Payload ID: 10197
  Gene Symbol: METTL22
  Gene Name: methyltransferase like 22
  ENSP ID: ENSP00000456618
MVQLAPAAAMDEVTFR

SEQ ID NO: 51075 - protein, 348 aa, Homo sapiens
  Payload ID: 10197
  Gene Symbol: METTL22
  Gene Name: methyltransferase like 22
  ENSP ID: ENSP00000457152
MVQLAPAAAMDEVTFRSDTVLSDVHLYTPNHRHLMVRLNSVGQPVFLSQFKLLWSQDSWTDSGAKGGSHRDVHTKEPPSAETGSTGSPPGSGHAQEEDDVLGEEAQGSPHDIIRIEHTMATPLEDVGKQVWRGALLLADYILFRQDLFRGCTALELGAGTGLASIIAATMARTVYCTDVGADLLSMCQRNIALNSHLAATGGGIVRVKELDWLKDDLCTDPKVPFSWSQEEISDLYDHTTILFAAEVFYDDDLTDAVFKTLSRLAHRLKNACTAILSVEKRLNFTLRHLDVTCEAYDHFRSCLHALEQLADGKLRFVVEPVEASFPQLLVYERLQQLELWKIIAEPVT

SEQ ID NO: 51076 - protein, 46 aa, Homo sapiens
  Payload ID: 10197
  Gene Symbol: METTL22
  Gene Name: methyltransferase like 22
  ENSP ID: ENSP00000457191
  MOD_RES (1)..(1): Any amino acid
XGIVRVKELDWLKDDLCTGVVVSLCGSMIIPELSQGPLQLVTRGNF

SEQ ID NO: 51077 - protein, 70 aa, Homo sapiens
  Payload ID: 10197
  Gene Symbol: METTL22
  Gene Name: methyltransferase like 22
  ENSP ID: ENSP00000457291
MVQLAPAAAMDEVTFRSDTVLSDVHLYTPNHRHLMVRLNSVGQPVFLSQFKLLWSQDSWTDSGAKGGSHR

SEQ ID NO: 51078 - protein, 47 aa, Homo sapiens
  Payload ID: 10197
  Gene Symbol: METTL22
  Gene Name: methyltransferase like 22
  ENSP ID: ENSP00000457913
MVQLAPAAAMDEVTFRSDTVLSDVHLYTPNHRHLMVRLNSVGQPGRD

SEQ ID NO: 51079 - protein, 154 aa, Homo sapiens
  Payload ID: 10197
  Gene Symbol: METTL22
  Gene Name: methyltransferase like 22
  ENSP ID: ENSP00000459729
RGCTALELGAGTGLASIIAATMARTVYCTDVGADLLSMCQRNIALNSHLAATGGGIVRVKELDWLKDDLCTDPKVPFSWSQEEISDLYDHTTILFAAEVFYDDDLTDAVFKTLSRLAHRLKNACTAILSVEKSLCVRLAGLQAQLHIETLGRHM

SEQ ID NO: 51080 - protein, 103 aa, Homo sapiens
  Payload ID: 10197
  Gene Symbol: METTL22
  Gene Name: methyltransferase like 22
  ENSP ID: ENSP00000460481
YDDDLTDAVFKTLSRLAHRLKNACTAILSVEKRLNFTLRHLDVTCEAYDHFRSCLHALEQLADGKLRFVVEPVEASFPQLLVYERLQQLVGPGPEAGPLVALL

SEQ ID NO: 51081 - protein, 165 aa, Homo sapiens
  Payload ID: 10197
  Gene Symbol: METTL22
  Gene Name: methyltransferase like 22
  ENSP ID: ENSP00000461054
  MOD_RES (1)..(1): Any amino acid
XVRVKELDWLKDDLCTDPKVPFSWSQEEISDLYDHTTILFAAEVFYDDDLTDAVFKTLSRLAHRLKNACTAILSVEKRLNFTLRHLDVTCEAYDHFRSCLHALEQLADGKLRFVVEPVEASFPQLLVYERLQQLPLCHSKIEQPRATKKGGSRPSAPAPARLLRG

SEQ ID NO: 51082 - protein, 190 aa, Homo sapiens
  Payload ID: 10198
  Gene Symbol: METTL23
  Gene Name: methyltransferase like 23
  Uniprot ID: Q86XA0
  ENSP ID: ENSP00000341543
MYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRHTVEMLVISFAKDSL

SEQ ID NO: 51083 - protein, 146 aa, Homo sapiens
  Payload ID: 10198
  Gene Symbol: METTL23
  Gene Name: methyltransferase like 23
  ENSP ID: ENSP00000464965
MYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRRQVWMTLTFYM

SEQ ID NO: 51084 - protein, 123 aa, Homo sapiens
  Payload ID: 10198
  Gene Symbol: METTL23
  Gene Name: methyltransferase like 23
  Uniprot ID: Q86XA0
  ENSP ID: ENSP00000465430
MNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRHTVEMLVISFAKDSL

SEQ ID NO: 51085 - protein, 123 aa, Homo sapiens; identical to SEQ ID NO: 51084
  Payload ID: 10198
  Gene Symbol: METTL23
  Gene Name: methyltransferase like 23
  Uniprot ID: Q86XA0
  ENSP ID: ENSP00000465890

SEQ ID NO: 51086 - protein, 71 aa, Homo sapiens
  Payload ID: 10198
  Gene Symbol: METTL23
  Gene Name: methyltransferase like 23
  ENSP ID: ENSP00000465959
MHKNPKVQLWSTYQVRSADWSLEALLYKWDMKCVHIPLESFDADKEDIAESTLPGRHTVEMLVISFAKDSL

SEQ ID NO: 51087 - protein, 123 aa, Homo sapiens; identical to SEQ ID NO: 51084
  Payload ID: 10198
  Gene Symbol: METTL23
  Gene Name: methyltransferase like 23
  Uniprot ID: Q86XA0
  ENSP ID: ENSP00000466203

SEQ ID NO: 51088 - protein, 79 aa, Homo sapiens
  Payload ID: 10198
  Gene Symbol: METTL23
  Gene Name: methyltransferase like 23
  ENSP ID: ENSP00000466614
MNNLPHLQVVGLTWGHISWDLLALPPQDIILASDVFFEPEDFEDILATIYFLMHKNPKVQLWSTYQVRRQVWMTLTFYM

SEQ ID NO: 51089 - protein, 138 aa, Homo sapiens
  Payload ID: 10198
  Gene Symbol: METTL23
  Gene Name: methyltransferase like 23
  ENSP ID: ENSP00000466938
MYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRRQC

SEQ ID NO: 51090 - protein, 56 aa, Homo sapiens
  Payload ID: 10198
  Gene Symbol: METTL23
  Gene Name: methyltransferase like 23
  ENSP ID: ENSP00000467101
MNNLPHLQVVGLTWGHISWDLLALPPQDIILASDVFFEPEDFEDILATIYFLMHKN

SEQ ID NO: 51091 - protein, 176 aa, Homo sapiens
  Payload ID: 10198
  Gene Symbol: METTL23
  Gene Name: methyltransferase like 23
  ENSP ID: ENSP00000467503
MYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSADWSLEALLYKWDMKCVHIPLESFDADKEDIAESTLPGRH

SEQ ID NO: 51092 - protein, 150 aa, Homo sapiens
  Payload ID: 10198
  Gene Symbol: METTL23
  Gene Name: methyltransferase like 23
  ENSP ID: ENSP00000467527
MYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSADWSLEALLYKWDM

SEQ ID NO: 51093 - protein, 138 aa, Homo sapiens; identical to SEQ ID NO: 51089
  Payload ID: 10198
  Gene Symbol: METTL23
  Gene Name: methyltransferase like 23
  ENSP ID: ENSP00000468386

SEQ ID NO: 51094 - protein, 71 aa, Homo sapiens
  Payload ID: 10198
  Gene Symbol: METTL23
  Gene Name: methyltransferase like 23
  ENSP ID: ENSP00000468704
MNNLPHLQVVGLTWGHISWDLLALPPQDIILASDVFFEPEDFEDILATIYFLMHKNPKVQLWSTYQVRRQC

SEQ ID NO: 51095 - protein, 190 aa, Homo sapiens; identical to SEQ ID NO: 51082
  Payload ID: 10198
  Gene Symbol: METTL23
  Gene Name: methyltransferase like 23
  Uniprot ID: Q86XA0
  ENSP ID: ENSP00000482599

SEQ ID NO: 51096 - protein, 366 aa, Homo sapiens
  Payload ID: 10199
  Gene Symbol: METTL24
  Gene Name: methyltransferase like 24
  Uniprot ID: Q5JXM2
  ENSP ID: ENSP00000344071
MARERPPGRGCGVLRRCLLGAVLLFGLRLCAELRRAGPGSPTRSAPPGPAWRPPGPHLPPAPGQPRGASRRQVTYVRSGRRAPPGGGGSGTPEPGCCAPRGRPRRKGPRWHIDLQPWAGSAQSLDEEAWRFLRYISTTQIACNHMNTDSLATDSSPTHKPWSVCLDDRFNLAHQIRNKQCRLYSLGLGSDDTHFEVSMANNGCEVHRFDPSVKSAHILESQHLWYHRLSIDWRDPHPAVAAQKPHSNTRKLGSILNEFGHHKIDVLKADLESAEWKVLENLILEDVLEQIGQLIFEIHLHWPGFEVSGSDSSVVRFWYSLLKELEQKDFRLFHSYKDLSKPQLFLKKDIFNASSCYTLSWVNTRWK

SEQ ID NO: 51097 - protein, 603 aa, Homo sapiens
  Payload ID: 10200
  Gene Symbol: METTL25
  Gene Name: methyltransferase like 25
  Uniprot ID: Q8N6Q8
  ENSP ID: ENSP00000248306
MAASCPLPVTPDLPTLRAKLQGLLQFLRDALSISNAHTVDFYTESVWEELVDLPPETVLAALRKSASETEALPSETRPLVEAEWEAGMTDFPKIFCETSQKLVSVEAFALAAKYYSVQNLGICTPFEQLLVALRGNQNQRIGENQKAVEFMNMKKSHEVQAMSELISSIADYYGIKQVIDLGSGKGYLSSFLSLKYGLKVYGIDSSNTNTHGAEERNRKLKKHWKLCHAQSRLDVNGLALKMAKERKVQNKVKNKADTEEVFNNSPTNQEKMPTSAILPDFSGSVISNIRNQMETLHSQPHQEENLCFENSFSLINLLPINAVEPTSSQQIPNRETSEANKERRKMTSKSSESNIYSPLTSFITADSELHDIIKDLEDCLMVGLHTCGDLAPNTLRIFTSNSEIKGVCSVGCCYHLLSEEFENQHKERTQEKWGFPMCHYLKEERWCCGRNARMSACLALERVAAGQGLPTESLFYRAVLQDIIKDCYGITKCDRHVGKIYSKCSSFLDYVRRSLKKLGLDESKLPEKIIMNYYEKYKPRMNELEAFNMLKVVLAPCIETLILLDRLCYLKEQEDIAWSALVKLFDPVKSPRCYAVIALKKQQ

SEQ ID NO: 51098 - protein, 239 aa, Homo sapiens
  Payload ID: 10200
  Gene Symbol: METTL25
  Gene Name: methyltransferase like 25
  ENSP ID: ENSP00000446878
MAASCPLPVTPDLPTLRAKLQGLLQFLRDALSISNAHTVDFYTESVWEELVDLPPETVLAALRKSASETEALPSETRPLVEAEWEAGMTDFPKIFCETSQKLVSVEAFALAAKYYSVQNLGICTPFEQLLVALRGNQNQRIGENQKAVEFMNMKKSHEVQAMSELISSIADYYGIKQVIDLGSGKGYLSSFLSLKYGLKVYGIDSSNTNTHGAEERNRKLKKHWKLCHAQSRLDVNGLA

SEQ ID NO: 51099 - protein, 143 aa, Homo sapiens
  Payload ID: 10200
  Gene Symbol: METTL25
  Gene Name: methyltransferase like 25
  ENSP ID: ENSP00000449730
DSELHDIIKDLEDCLMVGLHTCGDLAPNTLRIFTSNSEIKGVCSVGCCYHLLSEEFENQHKERTQEKWGFPMCHYLKEERWCCGRNARMSACLALERVAAGQGLPTESLFYRAVLQDIIKDCYGITKWYEDFILIRITMLYCK

SEQ ID NO: 51100 - protein, 189 aa, Homo sapiens
  Payload ID: 10200
  Gene Symbol: METTL25
  Gene Name: methyltransferase like 25
  ENSP ID: ENSP00000450317
  MOD_RES (1)..(1): Any amino acid
XGGSQQNQLLKMVCPEFLPSDVSRVSSFWWVHGPADFKNEAADLHGMTDFPKIFCETSQKLVSVEAFALAAKYYSVQNLGICTPFEQLLVALRGNQNQRIGENQKAVEFMNMKKSHEVQAMSELISSIADYYGIKQVIDLGSGKGYLSSFLSLKYGLKVYGIDSSNTNTHGAEERNRKLKKHWKLCHAQ

SEQ ID NO: 51101 - protein, 378 aa, Homo sapiens
  Payload ID: 10201
  Gene Symbol: METTL2A
  Gene Name: methyltransferase like 2A
  Uniprot ID: Q96IZ6
  ENSP ID: ENSP00000309610
MAGSYPEGAPAVLADKRQQFGSRFLRDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVPECRNNEDGPGLIMEEQHKCSSKSLEHKTQTLPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAIVPDKMQKAINRLSRLLKPGGMMLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 51102 - protein, 313 aa, Homo sapiens
  Payload ID: 10201
  Gene Symbol: METTL2A
  Gene Name: methyltransferase like 2A
  ENSP ID: ENSP00000479905
MPVDYEINAHKYWNDFYKIHENGFFKDRHWLFTEFPELAPSQNQNHLKDWFLENKSEVPECRNNEDGPGLIMEEQHKCSSKSLEHKTQTLPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAIVPDKMQKAINRLSRLLKPGGMMLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 51103 - protein, 378 aa, Homo sapiens
  Payload ID: 10202
  Gene Symbol: METTL2B
  Gene Name: methyltransferase like 2B
  Uniprot ID: Q6P1Q9
  ENSP ID: ENSP00000262432
MAGSYPEGAPAILADKRQQFGSRFLSDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAVVPDKMQKAINRLSRLLKPGGMVLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 51104 - protein, 106 aa, Homo sapiens
  Payload ID: 10202
  Gene Symbol: METTL2B
  Gene Name: methyltransferase like 2B
  ENSP ID: ENSP00000405144
  MOD_RES (1)..(1): Any amino acid
XSATYRILEVGCGVGNTVFPILQTNNDPGLFVYCCDFSSTAIELVQFTLSHCTDVISVHILKVCGNPASSKPTSAVSPPPYAHLVSVCHALVILRIFQTFLLLCML

SEQ ID NO: 51105 - protein, 76 aa, Homo sapiens
  Payload ID: 10202
  Gene Symbol: METTL2B
  Gene Name: methyltransferase like 2B
  ENSP ID: ENSP00000417616
MAGSYPEGAPAILADKRQQFGSRFLSDPARVFHHNAWDNVEWSEEQAAAAERKVQENSIQRVCQEKQVKDTWTTGH

SEQ ID NO: 51106 - protein, 313 aa, Homo sapiens
  Payload ID: 10202
  Gene Symbol: METTL2B
  Gene Name: methyltransferase like 2B
  Uniprot ID: Q6P1Q9
  ENSP ID: ENSP00000418402
MPVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAVVPDKMQKAINRLSRLLKPGGMVLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 51107 - protein, 150 aa, Homo sapiens
  Payload ID: 10202
  Gene Symbol: METTL2B
  Gene Name: methyltransferase like 2B
  ENSP ID: ENSP00000418989
VHDLCDEEKSYPVPKGSLDIIILIFVLSAVVPDKMQKAINRLSRLLKPGGMVLLRDYGRYDMAQLRFKKGQCLSGNFYVRGDGTRVYFFTQEELDTLFTTAGLEKVQNLVDRRLQFRQARWLTPVIPALWEAEAGRSPEVRSSRPAWPTW

SEQ ID NO: 51108 - protein, 580 aa, Homo sapiens
  Payload ID: 10203
  Gene Symbol: METTL3
  Gene Name: methyltransferase like 3
  Uniprot ID: Q86U44
  ENSP ID: ENSP00000298717
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKVSQEILELLNTTTAKEQSIVEKFRSRGRAQVQEFCDYGTKEECMKASDADRPCRKLHFRRIINKHTDESLGDCSFLNTCFHMDTCKYVHYEIDACMDSEAPGSKDHTPSQELALTQSVGGDSSADRLFPPQWICCDIRYLDVSILGKFAVVMADPPWDIHMELPYGTLTDDEMRRLNIPVLQDDGFLFLWVTGRAMELGRECLNLWGYERVDEIIWVKTNQLQRIIRTGRTGHWLNHGKEHCLVGVKGNPQGFNQGLDCDVIVAEVRSTSHKPDEIYGMIERLSPGTRKIELFGRPHNVQPNWITLGNQLDGIHLLDPDVVARFKQRYPDGIISKPKNL

SEQ ID NO: 51109 - protein, 9 aa, Homo sapiens
  Payload ID: 10203
  Gene Symbol: METTL3
  Gene Name: methyltransferase like 3
  ENSP ID: ENSP00000366766
MMGAVAEKK

SEQ ID NO: 51110 - protein, 245 aa, Homo sapiens
  Payload ID: 10203
  Gene Symbol: METTL3
  Gene Name: methyltransferase like 3
  ENSP ID: ENSP00000437692
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKTNYQ

SEQ ID NO: 51111 - protein, 336 aa, Homo sapiens
  Payload ID: 10203
  Gene Symbol: METTL3
  Gene Name: methyltransferase like 3
  ENSP ID: ENSP00000440598
  MOD_RES (1)..(1): Any amino acid
XVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKVSQEILELLNTTTAKEQSIVEKFRSRGRAQVQEFCDYGTKEECMKASDADRPCRKLHFRRIINKHTDESLGDCSFLNTCFHMDTCKYVHYEIDACMDSEAPGSKDHTPSQELALTQSVGGDSSADRLFPPQGHGVGERMSKPLGV

SEQ ID NO: 51112 - protein, 153 aa, Homo sapiens
  Payload ID: 10203
  Gene Symbol: METTL3
  Gene Name: methyltransferase like 3
  ENSP ID: ENSP00000442407
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEHRNQQRSQPRNQGNMLPQMLIWR

SEQ ID NO: 51113 - protein, 258 aa, Homo sapiens
  Payload ID: 10203
  Gene Symbol: METTL3
  Gene Name: methyltransferase like 3
  ENSP ID: ENSP00000445523
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKVGPKCKNSVTMEPRRSA

SEQ ID NO: 51114 - protein, 419 aa, Homo sapiens
  Payload ID: 10204
  Gene Symbol: METTL4
  Gene Name: methyltransferase like 4
  ENSP ID: ENSP00000320349
MSVVHQLSAGWLLDHLSFINKINYQLHQHHEPCCRKKEFTTSVHFESLQMDSVSSSGVCAAFIASDSSTKPENDDGGNYEMFTRKFVFRPELFDVTKPYITPAVHKECQQSNEKEDLMNGVKKEISISIIGKKRKRCVVFNQGELDAMEYHTKIRELILDGSLQLIQEGLKSGFLYPLFEKQDKGSKPITLPLDACSLSELCEMAKHLPSLNEMEHQTLQLVEEDTSVTEQDLFLRVVENNSSFTKVITLMGQKYLLPPKSSFLLSDISCMQPLLNYRKTFDVIVIDPPWQNKSVKRSNRYSYLSPLQIQQIPIPKLAAPNCLLVTWVTNRQKHLRFIKEELYPSWSVEVVAEWHWVKITNSGEFVFPLDSPHKKPYEGLILGRVQEKTALPLRGFKRLHQARWGIFGVVCSKFTARLD

SEQ ID NO: 51115 - protein, 472 aa, Homo sapiens
  Payload ID: 10204
  Gene Symbol: METTL4
  Gene Name: methyltransferase like 4
  Uniprot ID: Q8N3J2
  ENSP ID: ENSP00000458290
MSVVHQLSAGWLLDHLSFINKINYQLHQHHEPCCRKKEFTTSVHFESLQMDSVSSSGVCAAFIASDSSTKPENDDGGNYEMFTRKFVFRPELFDVTKPYITPAVHKECQQSNEKEDLMNGVKKEISISIIGKKRKRCVVFNQGELDAMEYHTKIRELILDGSLQLIQEGLKSGFLYPLFEKQDKGSKPITLPLDACSLSELCEMAKHLPSLNEMEHQTLQLVEEDTSVTEQDLFLRVVENNSSFTKVITLMGQKYLLPPKSSFLLSDISCMQPLLNYRKTFDVIVIDPPWQNKSVKRSNRYSYLSPLQIQQIPIPKLAAPNCLLVTWVTNRQKHLRFIKEELYPSWSVEVVAEWHWVKITNSGEFVFPLDSPHKKPYEGLILGRVQEKTALPLRNADVNVLPIPDHKLIVSVPCTLHSHKPPLAEVLKDYIKPDGEYLELFARNLQPGWTSWGNEVLKFQHVDYFIAVESGS

SEQ ID NO: 51116 - protein, 90 aa, Homo sapiens
  Payload ID: 10204
  Gene Symbol: METTL4
  Gene Name: methyltransferase like 4
  ENSP ID: ENSP00000458415
MEYHTKIRELILDGSLQLIQEGLKSGFLYPLFEKQDKGSKPITLPLDACSLSELCEMAKHLPSLNEMEHQTLQLVEEDTSVTEQDLFLRV

SEQ ID NO: 51117 - protein, 92 aa, Homo sapiens
  Payload ID: 10204
  Gene Symbol: METTL4
  Gene Name: methyltransferase like 4
  ENSP ID: ENSP00000460774
  MOD_RES (1)..(1): Any amino acid
XCMQPLLNYRKTFDVIVIDPPWQNKSVKRSNRYSYLSPLQIQQIPIPKLAAPNCLLVTWVTNRQKHLRFIKEELYPSWSVEVVAEWHWVKRF

SEQ ID NO: 51118 - protein, 21 aa, Homo sapiens
  Payload ID: 10204
  Gene Symbol: METTL4
  Gene Name: methyltransferase like 4
  ENSP ID: ENSP00000461097
MDSVSSSGVCAAFIASDSSTK

SEQ ID NO: 51119 - protein, 142 aa, Homo sapiens
  Payload ID: 10204
  Gene Symbol: METTL4
  Gene Name: methyltransferase like 4
  ENSP ID: ENSP00000477089
  MOD_RES (1)..(1): Any amino acid
XLSAGWLLDHLSFINKINYQLHQHHEPCCRKKEFTTSVHFESLQMDSVSSSGVCAAFIASDSSTKPENDDGGNYEMFTRKFVFRPELFDVTKPYITPAVHKECQQSNEKEDLMNGVKKEISISIIGKVESFKKYLFFSRKHN

SEQ ID NO: 51120 - protein, 209 aa, Homo sapiens
  Payload ID: 10205
  Gene Symbol: METTL5
  Gene Name: methyltransferase like 5
  Uniprot ID: Q9NRN9
  ENSP ID: ENSP00000260953
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELTNIDMVQCDVCLLSNRMSKSFDTVIMNPPFGTKNNKGTDMAFLKTALEMARTAVYSLHKSSTREHVQKKAAEWKIKIDIIAELRYDLPASYKFHKKKSVDIEVDLIRFSF

SEQ ID NO: 51121 - protein, 164 aa, Homo sapiens
  Payload ID: 10205
  Gene Symbol: METTL5
  Gene Name: methyltransferase like 5
  ENSP ID: ENSP00000307903
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELTNIDMVQCDVCLLSNRMSKSFDTVIMNPPFGTKNNKELRYDLPASYKFHKKKSVDIEVDLIRFSF

SEQ ID NO: 51122 - protein, 209 aa, Homo sapiens; identical to SEQ ID NO: 51120
  Payload ID: 10205
  Gene Symbol: METTL5
  Gene Name: methyltransferase like 5
  Uniprot ID: Q9NRN9
  ENSP ID: ENSP00000376415

SEQ ID NO: 51123 - protein, 209 aa, Homo sapiens; identical to SEQ ID NO: 51120
  Payload ID: 10205
  Gene Symbol: METTL5
  Gene Name: methyltransferase like 5
  Uniprot ID: Q9NRN9
  ENSP ID: ENSP00000386582

SEQ ID NO: 51124 - protein, 198 aa, Homo sapiens
  Payload ID: 10205
  Gene Symbol: METTL5
  Gene Name: methyltransferase like 5
  ENSP ID: ENSP00000386703
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELTNIDMVQCDVCLLSNRMSKSFDTVIMNPPFGTKNNKGTDMAFLKTALEMARTAVYSLHKSSTREHVQKKAAEWKIKIDIIAELRYDLPASYKFHKKKSV

SEQ ID NO: 51125 - protein, 244 aa, Homo sapiens
  Payload ID: 10205
  Gene Symbol: METTL5
  Gene Name: methyltransferase like 5
  ENSP ID: ENSP00000387056
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELTNIDMVQCDVCLLSNRMSKSFDTVIMNPPFGTKNNKGTDMAFLKTALEMARTAVYSLHKSSTREHVQKKAAEWKIKIDIIAELRYDLPASYKFHKKKSVSLLILAGLHSVLKSFLGRMWWFMPVIPATREAEARESLELRRQRLQ

SEQ ID NO: 51126 - protein, 110 aa, Homo sapiens
  Payload ID: 10205
  Gene Symbol: METTL5
  Gene Name: methyltransferase like 5
  ENSP ID: ENSP00000387106
MKKVRLKELESRLQQVDGFEKPKLLLEQYPTRPHIAGTDMAFLKTALEMARTAVYSLHKSSTREHVQKKAAEWKIKIDIIAELRYDLPASYKFHKKKSVDIEVDLIRFSF

SEQ ID NO: 51127 - protein, 126 aa, Homo sapiens
  Payload ID: 10205
  Gene Symbol: METTL5
  Gene Name: methyltransferase like 5
  ENSP ID: ENSP00000395792
  MOD_RES (1)..(1): Any amino acid
XNRNAEEFELTNIDMVQCDVCLLSNRMSKSFDTVIMNPPFGTKNNKGTDMAFLKTALEMARTAVYSLHKSSTREHVQKKAAEWKIKIDIIAGGFCFTELRYDLPASYKFHKKKSVDIEVDLIRFSF

SEQ ID NO: 51128 - protein, 87 aa, Homo sapiens
  Payload ID: 10205
  Gene Symbol: METTL5
  Gene Name: methyltransferase like 5
  ENSP ID: ENSP00000440589
QQVDGFEKPKLLLEQYPTRPHIAACMLYTIHNTYDDIENKVVADLGCGCGVLSIGTAMLGAGDRYGFSKDCFGNGKNSSIFLTQILN

SEQ ID NO: 51129 - protein, 48 aa, Homo sapiens
  Payload ID: 10205
  Gene Symbol: METTL5
  Gene Name: methyltransferase like 5
  ENSP ID: ENSP00000444989
MKKVRLKELESRLQQVDGFEKPKLLLEQYPTRPHIAELRYDLPASYKF

SEQ ID NO: 51130 - protein, 132 aa, Homo sapiens
  Payload ID: 10205
  Gene Symbol: METTL5
  Gene Name: methyltransferase like 5
  ENSP ID: ENSP00000479765
MKKVRLKELESRLQQVDGFEKPKLLLEQYPTRPHIAACMLYTIHNTYDDIENKVVADLGCGCGVLSIGTAMLGAGLCVGFDIDEDALEIFNRNAEEFELQILTWFNVMCAYYLTECPSHSIQNYESSLWDQK

SEQ ID NO: 51131 - protein, 240 aa, Homo sapiens
  Payload ID: 10206
  Gene Symbol: METTL6
  Gene Name: methyltransferase like 6
  Uniprot ID: Q8TCB7
  ENSP ID: ENSP00000373299
MASLQRKGLQARILTSEEEEKLKRDQTLVSDFKQQKLEQEAQKNWDLFYKRNSTNFFKDRHWTTREFEELRSCREFEDQKLTMLEAGCGVGNCLFPLLEEDPNIFAYACDFSPRAIEYVKQNPLYDTERCKVFQCDLTKDDLLDHVPPESVDVVMLIFVLSAVHPDKMHLVLQNIYKCHGCSSELRQPWDKDDFAVTWDPWSPAIRVLLCHSGWSAVAWTWLTAASTSWAQAVLPPQPLK

SEQ ID NO: 51132 - protein, 284 aa, Homo sapiens
  Payload ID: 10206
  Gene Symbol: METTL6
  Gene Name: methyltransferase like 6
  Uniprot ID: Q8TCB7
  ENSP ID: ENSP00000373300
MASLQRKGLQARILTSEEEEKLKRDQTLVSDFKQQKLEQEAQKNWDLFYKRNSTNFFKDRHWTTREFEELRSCREFEDQKLTMLEAGCGVGNCLFPLLEEDPNIFAYACDFSPRAIEYVKQNPLYDTERCKVFQCDLTKDDLLDHVPPESVDVVMLIFVLSAVHPDKMHLVLQNIYKVLKPGKSVLFRDYGLYDHAMLRFKASSKLGENFYVRQDGTRSYFFTDDFLAQLFMDTGYEEVVNEYVFRETVNKKEGLCVPRVFLQSKFLKPPKNPSPVVLGLDPKS

SEQ ID NO: 51133 - protein, 105 aa, Homo sapiens
  Payload ID: 10206
  Gene Symbol: METTL6
  Gene Name: methyltransferase like 6
  ENSP ID: ENSP00000400885
  MOD_RES (1)..(1): Any amino acid
XFQCDLTKDDLLDHVPPESVDVVMLIFVLSAVHPDKMHLVLQNIYKVLKPGKSVLFRDYGLYDHAMLRFKASSKLGENFYVRQDGTRSYFFTDGLKQKSGTWDSL

SEQ ID NO: 51134 - protein, 284 aa, Homo sapiens; identical to SEQ ID NO: 51132
  Payload ID: 10206
  Gene Symbol: METTL6
  Gene Name: methyltransferase like 6
  Uniprot ID: Q8TCB7
  ENSP ID: ENSP00000407613

SEQ ID NO: 51135 - protein, 239 aa, Homo sapiens
  Payload ID: 10206
  Gene Symbol: METTL6
  Gene Name: methyltransferase like 6
  ENSP ID: ENSP00000410726
MASLQRKGLQARILTSEEEEKLKRDQTLVSDFKQQKLEQEAQKNWDLFYKRNSTNFFKDRHWTTREFEELRSCREQNPLYDTERCKVFQCDLTKDDLLDHVPPESVDVVMLIFVLSAVHPDKMHLVLQNIYKVLKPGKSVLFRDYGLYDHAMLRFKASSKLGENFYVRQDGTRSYFFTDDFLAQLFMDTGYEEVVNEYVFRETVNKKEGLCVPRVFLQSKFLKPPKNPSPVVLGLDPKS

SEQ ID NO: 51136 - protein, 158 aa, Homo sapiens
  Payload ID: 10206
  Gene Symbol: METTL6
  Gene Name: methyltransferase like 6
  ENSP ID: ENSP00000412006
LFPLLEEDPNIFAYACDFSPRAIEYVKQNPLYDTERCKVFQCDLTKDDLLDHVPPESVDVVMLIFVLSAVHPDKMHLVLQNIYKCHGCSSELRQPWDKDDFAVTWDPWSPAIRLLGEGLRHVHETLKQALYCTIFTQHLEGTDLAPALEELTSLLWCQ

SEQ ID NO: 51137 - protein, 137 aa, Homo sapiens
  Payload ID: 10206
  Gene Symbol: METTL6
  Gene Name: methyltransferase like 6
  ENSP ID: ENSP00000471485
MASLQRKGLQARILTSEEEEKLKRDQTLVSDFKQQKLEQEAQKNWDLFYKRNSTNFFKDRHWTTREFEELRSCREQNPLYDTERCKVFQCDLTKDDLLDHVPPESVDVVMLIFVLSAVHPDKMHLVLQNIYKCHGCS

SEQ ID NO: 51138 - protein, 244 aa, Homo sapiens
  Payload ID: 10207
  Gene Symbol: METTL7A
  Gene Name: methyltransferase like 7A
  Uniprot ID: Q9H8H3
  ENSP ID: ENSP00000331787
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAECSTWNYFWQQVLDPAWHLLFDGCNLTRESWKALERASFSKLKLQHIQAPLSWELVRPHIYGYAVK

SEQ ID NO: 51139 - protein, 244 aa, Homo sapiens; identical to SEQ ID NO: 51138
  Payload ID: 10207
  Gene Symbol: METTL7A
  Gene Name: methyltransferase like 7A
  Uniprot ID: Q9H8H3
  ENSP ID: ENSP00000447542

SEQ ID NO: 51140 - protein, 244 aa, Homo sapiens
  Payload ID: 10207
  Gene Symbol: METTL7A
  Gene Name: methyltransferase like 7A
  ENSP ID: ENSP00000448286
  MOD_RES (1)..(1): Any amino acid
XELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAECSTWNYFWQQVLDPAWHLLFDGCNLTRESWKALERASFSKLKLQHIQAPLSWELVRPHIYGYAVK

SEQ ID NO: 51141 - protein, 244 aa, Homo sapiens; identical to SEQ ID NO: 51138
  Payload ID: 10207
  Gene Symbol: METTL7A
  Gene Name: methyltransferase like 7A
  Uniprot ID: Q9H8H3
  ENSP ID: ENSP00000448785

SEQ ID NO: 51142 - protein, 180 aa, Homo sapiens
  Payload ID: 10207
  Gene Symbol: METTL7A
  Gene Name: methyltransferase like 7A
  ENSP ID: ENSP00000450239
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAEC

SEQ ID NO: 51143 - protein, 244 aa, Homo sapiens
  Payload ID: 10208
  Gene Symbol: METTL7B
  Gene Name: methyltransferase like 7B
  Uniprot ID: Q6UX53
  ENSP ID: ENSP00000377796
MDILVPLLQLLVLLLTLPLHLMALLGCWQPLCKSYFPYLMAVLTPKSNRKMESKKRELFSQIKGLTGASGKVALLELGCGTGANFQFYPPGCRVTCLDPNPHFEKFLTKSMAENRHLQYERFVVAPGEDMRQLADGSMDVVVCTLVLCSVQSPRKVLQEVRRVLRPGGVLFFWEHVAEPYGSWAFMWQQVFEPTWKHIGDGCCLTRETWKDLENAQFSEIQMERQPPPLKWLPVGPHIMGKAVK

SEQ ID NO: 51144 - protein, 276 aa, Homo sapiens
  Payload ID: 10208
  Gene Symbol: METTL7B
  Gene Name: methyltransferase like 7B
  ENSP ID: ENSP00000482867
MDILVPLLQLLVLLLTLPLHLMALLGCWQPLCKSYFPYLMAVLTPKSNRKMESKKRELFSQIKGLTGASGKVALLELGCGTGANFQFYPPGCRVTCLDPNPHFEKFLTKSMAENRHLQYERFVVAPGEDMRQLADGSMDVVVCTLVLCSVQSPRKVLQEVRRVLRPGGVLFFWEHVAEPYGSWAFMWQQVFEPTWKHIGDGCCLTRETWKDLENAQFSEIQMERQPPPLKWLPVGPHIMGKAVKSFPSSKALICSFPSLQLEQATHQPIYLPLRGT

SEQ ID NO: 51145 - protein, 379 aa, Homo sapiens
  Payload ID: 10209
  Gene Symbol: METTL8
  Gene Name: methyltransferase like 8
  ENSP ID: ENSP00000364407
MNMIWRNSISCLRLGKVPHRYQSGYHPVAPLGSRILTDPAKVFEHNMWDHMQWSKEEEAAARKKVKENSAVRVLLEEQVKYEREASKYWDTFYKIHKNKFFKDRNWLLREFPEILPVDQKPEEKARESSWDHVKTSATNRFSRMHCPTVPDEKNHYEKSSGSSEGQSKTESDFSNLDSEKHKKGPMETGLFPGSNATFRILEVGCGAGNSVFPILNTLENSPESFLYCCDFASGAVELVKSHSSYRATQCFAFVHDVCDDGLPYPFPDGILDVILLVFVLSSIHPDRMQGVVNRLSKLLKPGGMLLFRDYGRYDKTQLRFKKGHCLSENFYVRGDGTRAYFFTKGEVHSMFCKASLDEKQNLVDRRLQVNRKKQVKMHR

SEQ ID NO: 51146 - protein, 226 aa, Homo sapiens
  Payload ID: 10209
  Gene Symbol: METTL8
  Gene Name: methyltransferase like 8
  ENSP ID: ENSP00000376377
MNMIWRNSISCLRLGKVPHRYQSGYHPVAPLGSRILTDPAKVFEHNMWDHMQWSKEEEAAARKKVKENSAVRVLLEEQVKYEREASKYWDTFYKIHKNKFFKDRNWLLREFPEILPVDQKPEEKARESSWDHVKTSATNRFSRMHCPTVPDEKNHYEKSSGSSEGQSKTESDFSNLDSEKHKKGPMETGLFPGSNATFRILESHSSYRATQCFAFVHDVCDDGLPY

SEQ ID NO: 51147 - protein, 291 aa, Homo sapiens
  Payload ID: 10209
  Gene Symbol: METTL8
  Gene Name: methyltransferase like 8
  Uniprot ID: Q9H825
  ENSP ID: ENSP00000376382
MNMIWRNSISCLRLGKVPHRYQSGYHPVAPLGSRILTDPAKVFEHNMWDHMQWSKEEEAAARKKVKENSAVRVLLEEQVKYEREASKYWDTFYKIHKNKFFKDRNWLLREFPEILPVDQKPEEKARESSWDHVKTSATNRFSRMHCPTVPDEKNHYEKSSGSSEGQSKTESDFSNLDSEKHKKGPMETGLFPGSNATFRILEVGCGAGNSVFPILNTLENSPESFLYCCDFASGAVELVKSHSSYRATQCFAFVHDVCDDGLPYPFPDGILDVILLVFVLSSIHPDRTLFI

SEQ ID NO: 51148 - protein, 153 aa, Homo sapiens
  Payload ID: 10209
  Gene Symbol: METTL8
  Gene Name: methyltransferase like 8
  ENSP ID: ENSP00000404646
MNMIWRNSISCLRLGKVPHRYQSGYHPVAPLGSRILTDPAKVFEHNMWDHMQWSKEEEAAARKKVKENSAVRVLLEEQVKYEREASKYWDTFYKIHKNKFFKDRNWLLREFPEILPVDQKPEEKARESSWDHVKTSATNRFSRMHCPTVPDEK

SEQ ID NO: 51149 - protein, 215 aa, Homo sapiens
  Payload ID: 10209
  Gene Symbol: METTL8
  Gene Name: methyltransferase like 8
  ENSP ID: ENSP00000407180
  MOD_RES (1)..(1): Any amino acid
XEKHKKGPMETGLFPGSNATFRILEVGCGAGNSVFPILNTLENSPESFLYCCDFASGAVELVKVCYSWESYQLMPKSHSSYRATQCFAFVHDVCDDGLPYPFPDGILDVILLVFVLSSIHPDRMQGVVNRLSKLLKPGGMLLFRDYGRYDKTQLRFKKGHCLSENFYVRGDGTRAYFFTKGEVHSMFCKASLDEKQNLVDRRLQVNRKKQVKMHR

SEQ ID NO: 51150 - protein, 241 aa, Homo sapiens
  Payload ID: 10209
  Gene Symbol: METTL8
  Gene Name: methyltransferase like 8
  Uniprot ID: Q9H825
  ENSP ID: ENSP00000409025
MQWSKEEEAAARKKVKENSAVRVLLEEQVKYEREASKYWDTFYKIHKNKFFKDRNWLLREFPEILPVDQKPEEKARESSWDHVKTSATNRFSRMHCPTVPDEKNHYEKSSGSSEGQSKTESDFSNLDSEKHKKGPMETGLFPGSNATFRILEVGCGAGNSVFPILNTLENSPESFLYCCDFASGAVELVKSHSSYRATQCFAFVHDVCDDGLPYPFPDGILDVILLVFVLSSIHPDRTLFI

SEQ ID NO: 51151 - protein, 105 aa, Homo sapiens
  Payload ID: 10209
  Gene Symbol: METTL8
  Gene Name: methyltransferase like 8
  ENSP ID: ENSP00000411589
MNMIWRNSISCLRLGKVPHRYQSGYHPVAPLGSRILTDPAKVFEHNMWDHMQWSKEEEAAARKKVKENSAVRVLLEEQVKYEREASKYWDTFYKIHKNKFFKDRN

SEQ ID NO: 51152 - protein, 83 aa, Homo sapiens
  Payload ID: 10209
  Gene Symbol: METTL8
  Gene Name: methyltransferase like 8
  ENSP ID: ENSP00000411942
MNMIWRNSISCLRLGKVPHRYQSGYHPVAPLGSRILTDPAKVFEHNMWDHMQWSKEEEAAARKKVKENSAVRVLLEEQVKYER

SEQ ID NO: 51153 - protein, 407 aa, Homo sapiens
  Payload ID: 10209
  Gene Symbol: METTL8
  Gene Name: methyltransferase like 8
  ENSP ID: ENSP00000480056
MNMIWRNSISCLRLGKVPHRYQSGYHPVAPLGSRILTDPAKVFEHNMWDHMQWSKEEEAAARKKVKENSAVRVLLEEQVKYEREASKYWDTFYKIHKNKFFKDRNWLLREFPEILPVDQKPEEKARESSWDHVKTSATNRFSRMHCPTVPDEKNHYEKSSGSSEGQSKTESDFSNLDSEKHKKGPMETGLFPGSNATFRILEVGCGAGNSVFPILNTLENSPESFLYCCDFASGAVELVKSHSSYRATQCFAFVHDVCDDGLPYPFPDGILDVILLVFVLSSIHPDRMQGVVNRLSKLLKPGGMLLFRDYGRYDKTQLRFKKGHCLSENFYVRGDGTRAYFFTKGEVHSMFCKASLDEKQNLVDRRLQVNRKKQVKMHRVWIQGKFQKPLHQTQNSSNMVSTLLSQD

SEQ ID NO: 51154 - protein, 318 aa, Homo sapiens
  Payload ID: 10210
  Gene Symbol: METTL9
  Gene Name: methyltransferase like 9
  Uniprot ID: Q9H1A3
  ENSP ID: ENSP00000350874
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNDYYVLDDAVFVLKPV

SEQ ID NO: 51155 - protein, 317 aa, Homo sapiens
  Payload ID: 10210
  Gene Symbol: METTL9
  Gene Name: methyltransferase like 9
  Uniprot ID: Q9H1A3
  ENSP ID: ENSP00000379335
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGGKWEKPSEILEIKGQNWEEQVNSLPEVFRKAGFVIEAFTRLPYLCEGDMYNDYYVLDDAVFVLKPV

SEQ ID NO: 51156 - protein, 139 aa, Homo sapiens
  Payload ID: 10210
  Gene Symbol: METTL9
  Gene Name: methyltransferase like 9
  ENSP ID: ENSP00000454239
MSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVEN

SEQ ID NO: 51157 - protein, 243 aa, Homo sapiens
  Payload ID: 10210
  Gene Symbol: METTL9
  Gene Name: methyltransferase like 9
  ENSP ID: ENSP00000454733
MDRKTTSWDTKFYEKWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKA

SEQ ID NO: 51158 - protein, 125 aa, Homo sapiens
  Payload ID: 10210
  Gene Symbol: METTL9
  Gene Name: methyltransferase like 9
  ENSP ID: ENSP00000455285
  MOD_RES (1)..(1): Any amino acid
XSYLDQGTQIFLNNSIEKSGWLFIQLYHSFVSSVFSLFMSRTSINGVLGINEWQNTGFQYDVISCLNLLDRCDQPLTLLKDIRSVLEPTRGRVILALVLPFHPYVENVGGKWEKPSEILEIKGQN

SEQ ID NO: 51159 - protein, 128 aa, Homo sapiens
  Payload ID: 10210
  Gene Symbol: METTL9
  Gene Name: methyltransferase like 9
  ENSP ID: ENSP00000455720
  MOD_RES (1)..(1): Any amino acid
XPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGKCGQSG

SEQ ID NO: 51160 - protein, 61 aa, Homo sapiens
  Payload ID: 10210
  Gene Symbol: METTL9
  Gene Name: methyltransferase like 9
  ENSP ID: ENSP00000456345
MRLLAGWLCLSLASVWLARRMWTLRSPLTRSLGMCATERNYANHSRLSLFRVTLIKEHRSS

SEQ ID NO: 51161 - protein, 74 aa, Homo sapiens
  Payload ID: 10210
  Gene Symbol: METTL9
  Gene Name: methyltransferase like 9
  ENSP ID: ENSP00000457311
MRLLAGWLCLSLASVWLARRMWTLRSPLTRSLYVNMTSGPGGPAAAAGGRKENHQVARKRLNVCVFTRSVSETA

SEQ ID NO: 51162 - protein, 282 aa, Homo sapiens
  Payload ID: 10210
  Gene Symbol: METTL9
  Gene Name: methyltransferase like 9
  ENSP ID: ENSP00000480710
MWTLRSPLTRSLYVKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNDYYVLDDAVFVLKPV

SEQ ID NO: 51163 - protein, 400 aa, Homo sapiens
  Payload ID: 10211
  Gene Symbol: MVD
  Gene Name: mevalonate (diphospho) decarboxylase
  Uniprot ID: P53602
  ENSP ID: ENSP00000301012
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 51164 - protein, 271 aa, Homo sapiens
  Payload ID: 10211
  Gene Symbol: MVD
  Gene Name: mevalonate (diphospho) decarboxylase
  ENSP ID: ENSP00000455131
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLVAAGVGLSPVIPVLKRLMGEKHCRPGVQDQPGQHTYTLARVYGVESDLSEVARRGSGSACRSLYGGFVEWQMGEQADGKDSIARQVAPESHWPELRVLILVVSAEKKLTGSTVGMRASVETSPLLRFRAESVVPARM

SEQ ID NO: 51165 - protein, 91 aa, Homo sapiens
  Payload ID: 10211
  Gene Symbol: MVD
  Gene Name: mevalonate (diphospho) decarboxylase
  ENSP ID: ENSP00000455602
MASEKPLAAVTCTAPVNIAVIKYWGKRDEELVLPINSSLSVTLHQDQLKTTTTAVISKDFTEDRIWLNGREEDVGQPRLQACLRESELGSP

SEQ ID NO: 51166 - protein, 41 aa, Homo sapiens
  Payload ID: 10211
  Gene Symbol: MVD
  Gene Name: mevalonate (diphospho) decarboxylase
  ENSP ID: ENSP00000456465
MASEKPLAAVTCTAPVNIAVIKYLEMGFHRVSQAGLKLLTS

SEQ ID NO: 51167 - protein, 51 aa, Homo sapiens
  Payload ID: 10211
  Gene Symbol: MVD
  Gene Name: mevalonate (diphospho) decarboxylase
  ENSP ID: ENSP00000458049
MASEKPLAAVTCTAPVNIAVIKYWSPGACPLAITELSKSSIIDSHESGQAR

SEQ ID NO: 51168 - protein, 138 aa, Homo sapiens
  Payload ID: 10211
  Gene Symbol: MVD
  Gene Name: mevalonate (diphospho) decarboxylase
  ENSP ID: ENSP00000479264
MGEQADGKDSIARQVAPESHWPELRVLILVVSAEKKLTGSTVGMRASVETSPLLRFRAESVVPAHGGDGPLHPGARLPQLRPADHEGQQPVPRHLPRHLPPSLTSMPSPGASSTWCTASTPTTGTPRWRTPLTRAPMP

SEQ ID NO: 51169 - protein, 396 aa, Homo sapiens
  Payload ID: 10212
  Gene Symbol: MVK
  Gene Name: mevalonate kinase
  Uniprot ID: Q03426
  ENSP ID: ENSP00000228510
MLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 51170 - protein, 344 aa, Homo sapiens
  Payload ID: 10212
  Gene Symbol: MVK
  Gene Name: mevalonate kinase
  ENSP ID: ENSP00000376487
MLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 51171 - protein, 83 aa, Homo sapiens
  Payload ID: 10212
  Gene Symbol: MVK
  Gene Name: mevalonate kinase
  ENSP ID: ENSP00000415555
MLSEVLLVSAPGKVILHGEHAVVHGKVALAVSLNLRTFLRLQPHSNGKVDLSLPNIGIKRAWDVARLQSLDTSFLGGPRRIWS

SEQ ID NO: 51172 - protein, 200 aa, Homo sapiens
  Payload ID: 10212
  Gene Symbol: MVK
  Gene Name: mevalonate kinase
  ENSP ID: ENSP00000438153
MLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNP

SEQ ID NO: 51173 - protein, 115 aa, Homo sapiens
  Payload ID: 10212
  Gene Symbol: MVK
  Gene Name: mevalonate kinase
  ENSP ID: ENSP00000439134
MGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 51174 - protein, 170 aa, Homo sapiens
  Payload ID: 10212
  Gene Symbol: MVK
  Gene Name: mevalonate kinase
  ENSP ID: ENSP00000440379
MLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKD

SEQ ID NO: 51175 - protein, 396 aa, Homo sapiens; identical to SEQ ID NO: 51169
  Payload ID: 10212
  Gene Symbol: MVK
  Gene Name: mevalonate kinase
  Uniprot ID: Q03426
  ENSP ID: ENSP00000443551

SEQ ID NO: 51176 - protein, 83 aa, Homo sapiens; identical to SEQ ID NO: 51171
  Payload ID: 10212
  Gene Symbol: MVK
  Gene Name: mevalonate kinase
  ENSP ID: ENSP00000443978

SEQ ID NO: 51177 - protein, 117 aa, Homo sapiens
  Payload ID: 10212
  Gene Symbol: MVK
  Gene Name: mevalonate kinase
  ENSP ID: ENSP00000445382
MLSEVLLVSAPGKVILHGEHAVVHGKVALAVSLNLRTFLRLQPHSNGKVDLSLPNIGIKRAWDVARLQSLDTSFLGSHSVMQPGVQWCDHSSLFLQPPGLKRSSCLSLLSSWDHRAR

SEQ ID NO: 51178 - protein, 83 aa, Homo sapiens; identical to SEQ ID NO: 51171
  Payload ID: 10212
  Gene Symbol: MVK
  Gene Name: mevalonate kinase
  ENSP ID: ENSP00000486804

SEQ ID NO: 51179 - protein, 344 aa, Homo sapiens; identical to SEQ ID NO: 51170
  Payload ID: 10212
  Gene Symbol: MVK
  Gene Name: mevalonate kinase
  ENSP ID: ENSP00000486846

SEQ ID NO: 51180 - protein, 520 aa, Homo sapiens
  Payload ID: 10213
  Gene Symbol: MEX3A
  Gene Name: mex-3 RNA binding family member A
  Uniprot ID: A1L020
  ENSP ID: ENSP00000432845
MPSLVVSGIMERNGGFGELGCFGGSAKDRGLLEDERALQLALDQLCLLGLGEPPAPTAGEDGGGGGGGAPAQPAAPPQPAPPPPPAAPPAAPTAAPAAQTPQPPTAPKGASDAKLCALYKEAELRLKGSSNTTECVPVPTSEHVAEIVGRQGCKIKALRAKTNTYIKTPVRGEEPVFMVTGRREDVATARREIISAAEHFSMIRASRNKSGAAFGVAPALPGQVTIRVRVPYRVVGLVVGPKGATIKRIQQQTNTYIITPSRDRDPVFEITGAPGNVERAREEIETHIAVRTGKILEYNNENDFLAGSPDAAIDSRYSDAWRVHQPGCKPLSTFRQNSLGCIGECGVDSGFEAPRLGEQGGDFGYGGYLFPGYGVGKQDVYYGVAETSPPLWAGQENATPTSVLFSSASSSSSSSAKARAGPPGAHRSPATSAGPELAGLPRRPPGEPLQGFSKLGGGGLRSPGGGRDCMVCFESEVTAALVPCGHNLFCMECAVRICERTDPECPVCHITATQAIRIFS

SEQ ID NO: 51181 - protein, 569 aa, Homo sapiens
  Payload ID: 10214
  Gene Symbol: MEX3B
  Gene Name: mex-3 RNA binding family member B
  Uniprot ID: Q6ZN04
  ENSP ID: ENSP00000329918
MPSSLFADLERNGSGGGGGGSSGGGETLDDQRALQLALDQLSLLGLDSDEGASLYDSEPRKKSVNMTECVPVPSSEHVAEIVGRQGCKIKALRAKTNTYIKTPVRGEEPVFVVTGRKEDVAMARREIISAAEHFSMIRASRNKNTALNGAVPGPPNLPGQTTIQVRVPYRVVGLVVGPKGATIKRIQQQTHTYIVTPSRDKEPVFEVTGMPENVDRAREEIEAHIALRTGGIIELTDENDFHANGTDVGFDLHHGSGGSGPGSLWSKPTPSITPTPGRKPFSSYRNDSSSSLGSASTDSYFGGGTSSSAAATQRLADYSPPSPALSFAHNGNNNNNGNGYTYTAGGEASVPSPDGCPELQPTFDPAPAPPPGAPLIWAQFERSPGGGPAAPVSSSCSSSASSSASSSSVVFPGGGASAPSNANLGLLVHRRLHPGTSCPRLSPPLHMAPGAGEHHLARRVRSDPGGGGLAYAAYANGLGAQLPGLQPSDTSGSSSSSSSSSSSSSSSSGLRRKGSRDCSVCFESEVIAALVPCGHNLFCMECANRICEKSEPECPVCHTAVTQAIRIFS

SEQ ID NO: 51182 - protein, 158 aa, Homo sapiens
  Payload ID: 10214
  Gene Symbol: MEX3B
  Gene Name: mex-3 RNA binding family member B
  Uniprot ID: Q6ZN04
  ENSP ID: ENSP00000456938
MPSSLFADLERNGSGGGGGGSSGGGETLDDQRALQLALDQLSLLGLDSDEGASLYDSEPRKKSVNMTECVPVPSSEHVAEIVGRQGRSRRDGEVGGGGVGSQATASRGRRVQYRDPRRGVPWGERKSRAMGRRPRQRKCRQAVSRSRAAALAGCTFFC

SEQ ID NO: 51183 - protein, 659 aa, Homo sapiens
  Payload ID: 10215
  Gene Symbol: MEX3C
  Gene Name: mex-3 RNA binding family member C
  Uniprot ID: Q5U5Q3
  ENSP ID: ENSP00000385610
MPSGSSAALALAAAPAPLPQPPPPPPPPPPPLPPPSGGPELEGDGLLLRERLAALGLDDPSPAEPGAPALRAPAAAAQGQARRAAELSPEERAPPGRPGAPEAAELELEEDEEEGEEAELDGDLLEEEELEEAEEEDRSSLLLLSPPAATASQTQQIPGGSLGSVLLPAARFDAREAAAAAAAAGVLYGGDDAQGMMAAMLSHAYGPGGCGAAAAALNGEQAALLRRKSVNTTECVPVPSSEHVAEIVGRQGCKIKALRAKTNTYIKTPVRGEEPIFVVTGRKEDVAMAKREILSAAEHFSMIRASRNKNGPALGGLSCSPNLPGQTTVQVRVPYRVVGLVVGPKGATIKRIQQQTHTYIVTPSRDKEPVFEVTGMPENVDRAREEIEMHIAMRTGNYIELNEENDFHYNGTDVSFEGGTLGSAWLSSNPVPPSRARMISNYRNDSSSSLGSGSTDSYFGSNRLADFSPTSPFSTGNFWFGDTLPSVGSEDLAVDSPAFDSLPTSAQTIWTPFEPVNPLSGFGSDPSGNMKTQRRGSQPSTPRLSPTFPESIEHPLARRVRSDPPSTGNHVGLPIYIPAFSNGTNSYSSSNGGSTSSSPPESRRKHDCVICFENEVIAALVPCGHNLFCMECANKICEKRTPSCPVCQTAVTQAIQIHS

SEQ ID NO: 51184 - protein, 115 aa, Homo sapiens
  Payload ID: 10215
  Gene Symbol: MEX3C
  Gene Name: mex-3 RNA binding family member C
  ENSP ID: ENSP00000468078
YGGDDAQGMMAAMLSHAYGPGGCGAAAAALNGEQAALLRRKSVNTTECVPVPSSEHVAEIVGRQGECRGGEVQLGMAPGVGGETRERSVGRKRRTRRGPQVHREGVWEEPRVDQM

SEQ ID NO: 51185 - protein, 489 aa, Homo sapiens
  Payload ID: 10215
  Gene Symbol: MEX3C
  Gene Name: mex-3 RNA binding family member C
  ENSP ID: ENSP00000482566
MPSGSSAALALAAAGVLYGGDDAQGMMAAMLSHAYGPGGCGAAAAALNGEQAALLRRKSVNTTECVPVPSSEHVAEIVGRQGCKIKALRAKTNTYIKTPVRGEEPIFVVTGRKEDVAMAKREILSAAEHFSMIRASRNKNGPALGGLSCSPNLPGQTTVQVRVPYRVVGLVVGPKGATIKRIQQQTHTYIVTPSRDKEPVFEVTGMPENVDRAREEIEMHIAMRTGNYIELNEENDFHYNGTDVSFEGGTLGSAWLSSNPVPPSRARMISNYRNDSSSSLGSGSTDSYFGSNRLADFSPTSPFSTGNFWFGDTLPSVGSEDLAVDSPAFDSLPTSAQTIWTPFEPVNPLSGFGSDPSGNMKTQRRGSQPSTPRLSPTFPESIEHPLARRVRSDPPSTGNHVGLPIYIPAFSNGTNSYSSSNGGSTSSSPPESRRKHDCVICFENEVIAALVPCGHNLFCMECANKICEKRTPSCPVCQTAVTQAIQIHS

SEQ ID NO: 51186 - protein, 651 aa, Homo sapiens
  Payload ID: 10216
  Gene Symbol: MEX3D
  Gene Name: mex-3 RNA binding family member D
  Uniprot ID: Q86XN8
  ENSP ID: ENSP00000384398
MPSSLGQPDGGGGGGGGGGGVGAAGEDPGPGPAPPPEGAQEAAPAPRPPPEPDDAAAALRLALDQLSALGLGGAGDTDEEGAAGDGAAAAGGADGGAAPEPVPPDGPEAGAPPTLAPAVAPGSLPLLDPNASPPPPPPPRPSPPDVFAGFAPHPAALGPPTLLADQMSVIGSRKKSVNMTECVPVPSSEHVAEIVGRQGCKIKALRAKTNTYIKTPVRGEEPVFIVTGRKEDVEMAKREILSAAEHFSIIRATRSKAGGLPGAAQGPPNLPGQTTIQVRVPYRVVGLVVGPKGATIKRIQQRTHTYIVTPGRDKEPVFAVTGMPENVDRAREEIEAHITLRTGAFTDAGPDSDFHANGTDVCLDLLGAAASLWAKTPNQGRRPPTATAGLRGDTALGAPSAPEAFYAGSRGGPSVPDPGPASPYSGSGNGGFAFGAEGPGAPVGTAAPDDCDFGFDFDFLALDLTVPAAATIWAPFERAAPLPAFSGCSTVNGAPGPPAAGARRSSGAGTPRHSPTLPEPGGLRLELPLSRRGAPDPVGALSWRPPQGPVSFPGGAAFSTATSLPSSPAAAACAPLDSGASENSRKPPSASSAPALARECVVCAEGEVMAALVPCGHNLFCMDCAVRICGKSEPECPACRTPATQAIHIFS

SEQ ID NO: 51187 - protein, 490 aa, Homo sapiens
  Payload ID: 10216
  Gene Symbol: MEX3D
  Gene Name: mex-3 RNA binding family member D
  ENSP ID: ENSP00000475059
VNMTECVPVPSSEHVAEIVGRQGCKIKALRAKTNTYIKTPVRGEEPVFIVTGRKEDVEMAKREILSAAEHFSIIRATRSKAGGLPGAAQGPPNLPGQTTIQVRVPYRVVGLVVGPKGATIKRIQQRTHTYIVTPGRDKEPVFAVTGMPENVDRAREEIEAHITLRTGAFTDAGPDSDFHANGTDVCLDLLGAAASLWAKTPNQGRRPPTATAGLRGDTALGAPSAPEAFYAGSRGGPSVPDPGPASPYSGSGNGGFAFGAEGPGAPVGTAAPDDCDFGFDFDFLALDLTVPAAATIWAPFERAAPLPAFSGCSTVNGAPGPPAAGARRSSGAGTPRHSPTLPEPGGLRLELPLSRRGAPDPVGALSWRPPQGPVSFPGGAAFSTATSLPSSPAAAACAPLDSGASENSRKPPSASSAPALARECVVCAEGEVMAALVPCGHNLFCMDCAVRICGKSEPECPACRTPATQAIRVETETPQPGGASALQRQY

SEQ ID NO: 51188 - protein, 321 aa, Homo sapiens
  Payload ID: 10217
  Gene Symbol: MFNG
  Gene Name: MFNG O-fucosylpeptide 3-beta-N-acetylglucosaminyltransferase
  Uniprot ID: O00587
  ENSP ID: ENSP00000349490
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 51189 - protein, 42 aa, Homo sapiens
  Payload ID: 10217
  Gene Symbol: MFNG
  Gene Name: MFNG O-fucosylpeptide 3-beta-N-acetylglucosaminyltransferase
  ENSP ID: ENSP00000389274
MAAEFDTFLASGLRWFCHVDDDNYVNPRALLQLLRAFPLARD

SEQ ID NO: 51190 - protein, 132 aa, Homo sapiens
  Payload ID: 10217
  Gene Symbol: MFNG
  Gene Name: MFNG O-fucosylpeptide 3-beta-N-acetylglucosaminyltransferase
  ENSP ID: ENSP00000394081
MAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFH

SEQ ID NO: 51191 - protein, 87 aa, Homo sapiens
  Payload ID: 10217
  Gene Symbol: MFNG
  Gene Name: MFNG O-fucosylpeptide 3-beta-N-acetylglucosaminyltransferase
  ENSP ID: ENSP00000407094
  MOD_RES (1)..(1): Any amino acid
XSHLETLQLLRTAQLPEQISLPPLSALSRYTLVSPAGCPMNPELLGKGWAETSGCALAPKVALWVPGKCLVIGSPWQGLRVVGKPRI

SEQ ID NO: 51192 - protein, 118 aa, Homo sapiens
  Payload ID: 10217
  Gene Symbol: MFNG
  Gene Name: MFNG O-fucosylpeptide 3-beta-N-acetylglucosaminyltransferase
  ENSP ID: ENSP00000407110
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSPDSSSLLQGPTLWSP

SEQ ID NO: 51193 - protein, 307 aa, Homo sapiens
  Payload ID: 10217
  Gene Symbol: MFNG
  Gene Name: MFNG O-fucosylpeptide 3-beta-N-acetylglucosaminyltransferase
  Uniprot ID: O00587
  ENSP ID: ENSP00000413855
MQCRLPRGLAGALLTLLCMGLLCLRYHLNLSPQRVQGTPELSQPNPGPPKLQLHDVFIAVKTTRAFHRLRLELLLDTWVSRTREQVTRSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 51194 - protein, 130 aa, Homo sapiens
  Payload ID: 10217
  Gene Symbol: MFNG
  Gene Name: MFNG O-fucosylpeptide 3-beta-N-acetylglucosaminyltransferase
  ENSP ID: ENSP00000414222
MQCRLPRGLAGALLTLLCMGLLCLRYHLNLSPQRVQGTPELSQPNPGPPKLQLHDVFIAVKTTRAFHRLRLELLLDTWVSRTREQGPTLWSPTAPRNTATQLCPARWLLSSTPSWPVGLGGSAMWTMTTM

SEQ ID NO: 51195 - protein, 127 aa, Homo sapiens
  Payload ID: 10217
  Gene Symbol: MFNG
  Gene Name: MFNG O-fucosylpeptide 3-beta-N-acetylglucosaminyltransferase
  ENSP ID: ENSP00000414342
MQCRLPRGLAGALLTLLCMGLLCLRYHLNLSPQRVQGTPELSQPNPGPPKLQLHDVFIAVKTTRAFHRLRLELLLDTWVSRTREQVTNICLHRQPRQRPPGETGVPPCGHQLLRGTQPPSSVLQDGC

SEQ ID NO: 51196 - protein, 3065 aa, Homo sapiens
  Payload ID: 10218
  Gene Symbol: MGA
  Gene Name: MGA, MAX dimerization protein
  Uniprot ID: Q8IWI9
  ENSP ID: ENSP00000219905
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPVIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIAARPSPGGVFTQFVMSKVGALQQKIPGVSTPQTLAGTQKFSIRPSPVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 51197 - protein, 2856 aa, Homo sapiens
  Payload ID: 10218
  Gene Symbol: MGA
  Gene Name: MGA, MAX dimerization protein
  Uniprot ID: Q8IWI9
  ENSP ID: ENSP00000442467
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPVIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 51198 - protein, 1086 aa, Homo sapiens
  Payload ID: 10218
  Gene Symbol: MGA
  Gene Name: MGA, MAX dimerization protein
  ENSP ID: ENSP00000455155
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRK

SEQ ID NO: 51199 - protein, 2856 aa, Homo sapiens; identical to SEQ ID NO: 51197
  Payload ID: 10218
  Gene Symbol: MGA
  Gene Name: MGA, MAX dimerization protein
  Uniprot ID: Q8IWI9
  ENSP ID: ENSP00000456141

SEQ ID NO: 51200 - protein, 3065 aa, Homo sapiens; identical to SEQ ID NO: 51196
  Payload ID: 10218
  Gene Symbol: MGA
  Gene Name: MGA, MAX dimerization protein
  Uniprot ID: Q8IWI9
  ENSP ID: ENSP00000457035

SEQ ID NO: 51201 - protein, 1138 aa, Homo sapiens
  Payload ID: 10218
  Gene Symbol: MGA
  Gene Name: MGA, MAX dimerization protein
  ENSP ID: ENSP00000457151
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKR

SEQ ID NO: 51202 - protein, 83 aa, Homo sapiens
  Payload ID: 10218
  Gene Symbol: MGA
  Gene Name: MGA, MAX dimerization protein
  ENSP ID: ENSP00000457250
  MOD_RES (1)..(1): Any amino acid
XDQEGNNISSSSGHRVRLTEGQGSEIQPGDLDPLSRGHETSGKGLEKTSLNIKRDFLGFMDTDSALSEVPQLKQEISEWYSFA

SEQ ID NO: 51203 - protein, 1174 aa, Homo sapiens
  Payload ID: 10218
  Gene Symbol: MGA
  Gene Name: MGA, MAX dimerization protein
  ENSP ID: ENSP00000457474
  MOD_RES (1)..(1): Any amino acid
XLTCDLEDDSDKLQEKSWKSSCNEGESSSTSYMHQRSPGGPTKLIEIISDCNWEEDRNKILSILSQHINSNMPQSLKVNGKSYPQAKLLLGQMGALHPANRLAAYITGRLRPSVLDLSTLSTVISKVASNAKVAASRKPRTLLPSTSNSKMASSSGTATNRPGKNLKAFVPAKRPIAARPSPGGVFTQFVMSKVGALQQKIPGVSTPQTLAGTQKFSIRPSPVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEA

SEQ ID NO: 51204 - protein, 61 aa, Homo sapiens [sequence omitted]

SEQ ID NO: 51205 - protein, 478 aa, Homo sapiens
  Payload ID: 10219
  Gene Symbol: MGAT4C
  Gene Name: MGAT4 family, member C
  Uniprot ID: Q9UBM8
  ENSP ID: ENSP00000446647
MFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKRYLTIGLSSVKRKKGNYLLETIKSIFEQSSYEELKEISVVVHLADFNSSWRDAMVQDITQKFAHHIIAGRLMVIHAPEEYYPILDGLKRNYNDPEDRVKFRSKQNVDYAFLLNFCANTSDYYVMLEDDVRCSKNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASLYTNMNVFENYEASKAYSSVDEYFWGKPPSTGDVFVIVFENPIIIKKIKVNTGTEDRQNDILHHGALDVGENVMPSKQRRQCSTYLRLGEFKNGNFEMSGVNQKIPFDIHCMRIYVTKTQKEWLIIRSISIWTS

SEQ ID NO: 51206 - protein, 478 aa, Homo sapiens; identical to SEQ ID NO: 51205
  Payload ID: 10219
  Gene Symbol: MGAT4C
  Gene Name: MGAT4 family, member C
  Uniprot ID: Q9UBM8
  ENSP ID: ENSP00000447253

SEQ ID NO: 51207 - protein, 111 aa, Homo sapiens
  Payload ID: 10219
  Gene Symbol: MGAT4C
  Gene Name: MGAT4 family, member C
  ENSP ID: ENSP00000448093
MFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKPHGLLFIIQRDGE

SEQ ID NO: 51208 - protein, 397 aa, Homo sapiens
  Payload ID: 10219
  Gene Symbol: MGAT4C
  Gene Name: MGAT4 family, member C
  ENSP ID: ENSP00000449172
MFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKRYLTIGLSSVKRKKGNYLLETIKSIFEQSSYEELKEISVVVHLADFNSSWRDAMVQDITQKFAHHIIAGRLMVIHAPEEYYPILDGLKRNYNDPEDRVKFRSKQNVDYAFLLNFCANTSDYYVMLEDDVRCSKNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASLYTNMNVFENYEASKAYSSVDEYFWGKPPSTGDVFVIVFENPIIIKKIKVNTG

SEQ ID NO: 51209 - protein, 478 aa, Homo sapiens; identical to SEQ ID NO: 51205
  Payload ID: 10219
  Gene Symbol: MGAT4C
  Gene Name: MGAT4 family, member C
  Uniprot ID: Q9UBM8
  ENSP ID: ENSP00000477650

SEQ ID NO: 51210 - protein, 478 aa, Homo sapiens; identical to SEQ ID NO: 51205
  Payload ID: 10219
  Gene Symbol: MGAT4C
  Gene Name: MGAT4 family, member C
  Uniprot ID: Q9UBM8
  ENSP ID: ENSP00000478300

SEQ ID NO: 51211 - protein, 478 aa, Homo sapiens; identical to SEQ ID NO: 51205
  Payload ID: 10219
  Gene Symbol: MGAT4C
  Gene Name: MGAT4 family, member C
  Uniprot ID: Q9UBM8
  ENSP ID: ENSP00000481096

SEQ ID NO: 51212 - protein, 374 aa, Homo sapiens
  Payload ID: 10220
  Gene Symbol: MGAT4D
  Gene Name: MGAT4 family, member D
  Uniprot ID: A6NG13
  ENSP ID: ENSP00000421185
MRTKQVNLLITLVAVALFSFSCFSIYRITQTNNQLINCRNHILEFKENMLHLRNKTEKNTQEMMKVLNRMKYEITKREILSGNLVAQKADILNKNETVSNTFEDLKFFFPHLRKEGRIYPDVIIGKGKTGVSFALGISTVNRGNYSYLKQTLTSVVSRMTLSQEKDSVVIVLVADSNEDYLHSVVKMITKKFKRQVRSGSLEVISIPAFLYSSMLNAKHLAEASQKLASWRIKQVLDFCILLLYAQPKAKYYLQLEDDIIAKEMYFTKITDFVGNISSNNWFFIEFSMLGFIGKLFRSEDLTHFVRFFLMFYKEKPIDWLLNDIFQVKVCDAGEDLRNCMKRKKQIRIQYKPSLFQHVGIHSSFPRKEQYEKKI

SEQ ID NO: 51213 - protein, 91 aa, Homo sapiens
  Payload ID: 10220
  Gene Symbol: MGAT4D
  Gene Name: MGAT4 family, member D
  ENSP ID: ENSP00000422714
  MOD_RES (1)..(1): Any amino acid
XNISSNNWFFIEFSMLGFIGKLFRSEDLTHFVRFFLMFYKEKPIDWLLNDIFQRNCMKRKKQIRIQYKPSLFQHVGIHSSFPRKEQYEKKI

SEQ ID NO: 51214 - protein, 166 aa, Homo sapiens
  Payload ID: 10220
  Gene Symbol: MGAT4D
  Gene Name: MGAT4 family, member D
  ENSP ID: ENSP00000423767
MRTKQVNLLITLVAVALFSFSCFSIYRITQTNNQLINCRNHILEFKENMLHLRNKTEKNTQEMMKVLNRMKYEITKREILSGNLGKLFRSEDLTHFVRFFLMFYKEKPIDWLLNDIFQVKVCDAGEDLRNCMKRKKQIRIQYKPSLFQHVGIHSSFPRKEQYEKKI

SEQ ID NO: 51215 - protein, 113 aa, Homo sapiens
  Payload ID: 10220
  Gene Symbol: MGAT4D
  Gene Name: MGAT4 family, member D
  ENSP ID: ENSP00000423768
MRTKQVNLLITLVAVALFSFSCFSIYRITQTISFALGISTVNRGNYSYLKQTLTSVVSRMTLSQEKDSVVIVLVADSNEDYLHSVVKMITKKFKRQVRSGSLEVISIPAFLYS

SEQ ID NO: 51216 - protein, 36 aa, Homo sapiens
  Payload ID: 10220
  Gene Symbol: MGAT4D
  Gene Name: MGAT4 family, member D
  ENSP ID: ENSP00000425945
MRTKQVNLLITLVAVALFSFSCFSIYRITQTNSKGK

SEQ ID NO: 51217 - protein, 375 aa, Homo sapiens
  Payload ID: 10220
  Gene Symbol: MGAT4D
  Gene Name: MGAT4 family, member D
  ENSP ID: ENSP00000426225
MRTKQVNLLITLVAVALFSFSCFSIYRITQTNNQLINCRNHILEFKENMLHLRNKTEKNTQEMMKVLNRMKYEITKREILSGNLVAQKADILNKNETVSNTFEDLKFFFPHLRKEGRIYPDVIIGKGKTGVSFALGISTVNRGNYSYLKQTLTSVVSRMTLSQEKDSVVIVLVADSNEDYLHSVVKMITKKFKRQVRSGSLEVISIPAFLYSSMLNAKHLAEASQKLASWRIKQVLDFCILLLYAQPKAKYYLQLEDDIIAKEMYFTKITDFVGNISSNNWFFIEFSMLGFIGKLFRSEDLTHFVRFFLMFYKEKPIDWLLNDIFQVKVCDAGEDLRNCMKRKKQIRIQYKPSLFQHVGIHSSFPRKEQYEKDVY

SEQ ID NO: 51218 - protein, 245 aa, Homo sapiens
  Payload ID: 10221
  Gene Symbol: MICA
  Gene Name: MHC class I polypeptide-related sequence A
  ENSP ID: ENSP00000383176
MGQRDQRLDRERKGPQDDPGSYQGPERRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 51219 - protein, 383 aa, Homo sapiens
  Payload ID: 10221
  Gene Symbol: MICA
  Gene Name: MHC class I polypeptide-related sequence A
  Uniprot ID: Q29983
  ENSP ID: ENSP00000383179
MGLGPVFLLLAGIFPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 51220 - protein, 332 aa, Homo sapiens
  Payload ID: 10221
  Gene Symbol: MICA
  Gene Name: MHC class I polypeptide-related sequence A
  ENSP ID: ENSP00000394553
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 51221 - protein, 342 aa, Homo sapiens
  Payload ID: 10221
  Gene Symbol: MICA
  Gene Name: MHC class I polypeptide-related sequence A
  ENSP ID: ENSP00000395645
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPQSSRAQTLAMNVRNFLKEDAMKTKTHYHAMHADCLQELRRYLESSVVLRRRVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 51222 - protein, 289 aa, Homo sapiens
  Payload ID: 10221
  Gene Symbol: MICA
  Gene Name: MHC class I polypeptide-related sequence A
  ENSP ID: ENSP00000395954
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 51223 - protein, 276 aa, Homo sapiens
  Payload ID: 10221
  Gene Symbol: MICA
  Gene Name: MHC class I polypeptide-related sequence A
  ENSP ID: ENSP00000398552
FPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 51224 - protein, 385 aa, Homo sapiens
  Payload ID: 10221
  Gene Symbol: MICA
  Gene Name: MHC class I polypeptide-related sequence A
  Uniprot ID: Q29983
  ENSP ID: ENSP00000402134
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNVETEEWTVPQSSRAQTLAMNVRNFLKEDAMKTKTHYHAMHADCLQELRRYLESSVVLRRRVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 51225 - protein, 223 aa, Homo sapiens
  Payload ID: 10221
  Gene Symbol: MICA
  Gene Name: MHC class I polypeptide-related sequence A
  ENSP ID: ENSP00000402410
FPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 51226 - protein, 274 aa, Homo sapiens
  Payload ID: 10221
  Gene Symbol: MICA
  Gene Name: MHC class I polypeptide-related sequence A
  ENSP ID: ENSP00000404397
FPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 51227 - protein, 194 aa, Homo sapiens
  Payload ID: 10221
  Gene Symbol: MICA
  Gene Name: MHC class I polypeptide-related sequence A
  ENSP ID: ENSP00000405177
MGQRDQGLDRERKGPQDDPGSYQGPERRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 51228 - protein, 194 aa, Homo sapiens; identical to SEQ ID NO: 51227
  Payload ID: 10221
  Gene Symbol: MICA
  Gene Name: MHC class I polypeptide-related sequence A
  ENSP ID: ENSP00000405741

SEQ ID NO: 51229 - protein, 247 aa, Homo sapiens
  Payload ID: 10221
  Gene Symbol: MICA
  Gene Name: MHC class I polypeptide-related sequence A
  ENSP ID: ENSP00000407264
MGQRDQGLDRERKGPQDDPGSYQGPERRNFLKEDAMKTKTHYHAMHADCLQELRRYLESSVVLRRRVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 51230 - protein, 223 aa, Homo sapiens; identical to SEQ ID NO: 51225
  Payload ID: 10221
  Gene Symbol: MICA
  Gene Name: MHC class I polypeptide-related sequence A
  ENSP ID: ENSP00000409422

SEQ ID NO: 51231 - protein, 223 aa, Homo sapiens; identical to SEQ ID NO: 51225
  Payload ID: 10221
  Gene Symbol: MICA
  Gene Name: MHC class I polypeptide-related sequence A
  ENSP ID: ENSP00000412989

SEQ ID NO: 51232 - protein, 289 aa, Homo sapiens; identical to SEQ ID NO: 51222
  Payload ID: 10221
  Gene Symbol: MICA
  Gene Name: MHC class I polypeptide-related sequence A
  ENSP ID: ENSP00000412992

SEQ ID NO: 51233 - protein, 332 aa, Homo sapiens; identical to SEQ ID NO: 51220
  Payload ID: 10221
  Gene Symbol: MICA
  Gene Name: MHC class I polypeptide-related sequence A
  ENSP ID: ENSP00000413079

SEQ ID NO: 51234 - protein, 332 aa, Homo sapiens; identical to SEQ ID NO: 51220
  Payload ID: 10221
  Gene Symbol: MICA
  Gene Name: MHC class I polypeptide-related sequence A
  ENSP ID: ENSP00000416941

SEQ ID NO: 51235 - protein, 212 aa, Homo sapiens
  Payload ID: 10221
  Gene Symbol: MICA
  Gene Name: MHC class I polypeptide-related sequence A
  ENSP ID: ENSP00000433021
MGLGPVFLLLAGIFPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEVLQSSDLGHERQEFLEGRCHEDQDTLSRYACRLPAGTTAISKIRRSPEENSAPHGECHPQRGLRGQHYRDMQGFWLLSLEYHTELASGWGIFEPRHPAVGGCPA

SEQ ID NO: 51236 - protein, 332 aa, Homo sapiens; identical to SEQ ID NO: 51220
  Payload ID: 10221
  Gene Symbol: MICA
  Gene Name: MHC class I polypeptide-related sequence A
  ENSP ID: ENSP00000446655

SEQ ID NO: 51237 - protein, 383 aa, Homo sapiens; identical to SEQ ID NO: 51219
  Payload ID: 10221
  Gene Symbol: MICA
  Gene Name: MHC class I polypeptide-related sequence A
  Uniprot ID: Q29983
  ENSP ID: ENSP00000446963

SEQ ID NO: 51238 - protein, 332 aa, Homo sapiens; identical to SEQ ID NO: 51220
  Payload ID: 10221
  Gene Symbol: MICA
  Gene Name: MHC class I polypeptide-related sequence A
  ENSP ID: ENSP00000447026

SEQ ID NO: 51239 - protein, 235 aa, Homo sapiens
  Payload ID: 10221
  Gene Symbol: MICA
  Gene Name: MHC class I polypeptide-related sequence A
  ENSP ID: ENSP00000480992
MTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 51240 - protein, 235 aa, Homo sapiens; identical to SEQ ID NO: 51239
  Payload ID: 10221
  Gene Symbol: MICA
  Gene Name: MHC class I polypeptide-related sequence A
  ENSP ID: ENSP00000482382

SEQ ID NO: 51241 - protein, 235 aa, Homo sapiens; identical to SEQ ID NO: 51239
  Payload ID: 10221
  Gene Symbol: MICA
  Gene Name: MHC class I polypeptide-related sequence A
  ENSP ID: ENSP00000482763

SEQ ID NO: 51242 - protein, 383 aa, Homo sapiens
  Payload ID: 10222
  Gene Symbol: MICB
  Gene Name: MHC class I polypeptide-related sequence B
  ENSP ID: ENSP00000252229
MGLGRVLLFLAVAFPFAPPAAAAEPHSLRYNLMVLSQDGSVQSGFLAEGHLDGQPFLRYDRQKRRAKPQGQWAENVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 51243 - protein, 383 aa, Homo sapiens
  Payload ID: 10222
  Gene Symbol: MICB
  Gene Name: MHC class I polypeptide-related sequence B
  ENSP ID: ENSP00000373006
MGLGRVLLFLAVAFPFAPPAAAAEPHSLRYNLMVLSQDGSVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVICSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 51244 - protein, 340 aa, Homo sapiens
  Payload ID: 10222
  Gene Symbol: MICB
  Gene Name: MHC class I polypeptide-related sequence B
  Uniprot ID: Q29980
  ENSP ID: ENSP00000382103
MGLGRVLLFLAVAFPFAPPAAAAEPHSLRYNLMVLSQDGSVQSGFLAEGHLDGQPFLRYDRQKRRAKPQGQWAENVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 51245 - protein, 340 aa, Homo sapiens
  Payload ID: 10222
  Gene Symbol: MICB
  Gene Name: MHC class I polypeptide-related sequence B
  ENSP ID: ENSP00000383167
MGLGRVLLFLAVAFPFAPPAAAAEPHSLRYNLMVLSQDGSVQSGFLAEGHLDGQPFLRYDRQKRRAKPQGQWAEDVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 51246 - protein, 340 aa, Homo sapiens; identical to SEQ ID NO: 51244
  Payload ID: 10222
  Gene Symbol: MICB
  Gene Name: MHC class I polypeptide-related sequence B
  ENSP ID: ENSP00000387401

SEQ ID NO: 51247 - protein, 383 aa, Homo sapiens [sequence omitted]

SEQ ID NO: 51248 - protein, 360 aa, Homo sapiens
  Payload ID: 10222
  Gene Symbol: MICB
  Gene Name: MHC class I polypeptide-related sequence B
  ENSP ID: ENSP00000394437
  MOD_RES (1)..(1): Any amino acid
XPHSLRYNLMVLSQDGSVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 51249 - protein, 340 aa, Homo sapiens
  Payload ID: 10222
  Gene Symbol: MICB
  Gene Name: MHC class I polypeptide-related sequence B
  Uniprot ID: Q29980
  ENSP ID: ENSP00000398212
MGLGRVLLFLAVAFPFAPPAAAAEPHSLRYNLMVLSQDGSVQSGFLAEGHLDGQPFLRYDRQKRRAKPQGQWAEDVLGAETWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 51250 - protein, 383 aa, Homo sapiens [sequence omitted]

SEQ ID NO: 51251 - protein, 340 aa, Homo sapiens
  Payload ID: 10222
  Gene Symbol: MICB
  Gene Name: MHC class I polypeptide-related sequence B
  ENSP ID: ENSP00000400122
MGLGRVLLFLAVAFPFAPPAAAAEPHSLRYNLMVLSQDGSVQSGFLAEGHLDGQPFLRYDRQKRRAKPQGQWAEDVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVICSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 51252 - protein, 383 aa, Homo sapiens
  Payload ID: 10222
  Gene Symbol: MICB
  Gene Name: MHC class I polypeptide-related sequence B
  Uniprot ID: Q29980
  ENSP ID: ENSP00000402484
MGLGRVLLFLAVAFPFAPPAAAAEPHSLRYNLMVLSQDGSVQSGFLAEGHLDGQPFLRYDRQKRRAKPQGQWAEDVLGAETWDTETEDLTENGQDLRRTLTHIKDQKGGLHSLQEIRVCEIHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 51253 - protein, 317 aa, Homo sapiens
  Payload ID: 10222
  Gene Symbol: MICB
  Gene Name: MHC class I polypeptide-related sequence B
  ENSP ID: ENSP00000403513
  MOD_RES (1)..(1): Any amino acid
XPHSLRYNLMVLSQDGSVQSGFLAEGHLDGQPFLRYDRQKRRAKPQGQWAEDVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 51254 - protein, 383 aa, Homo sapiens
  Payload ID: 10222
  Gene Symbol: MICB
  Gene Name: MHC class I polypeptide-related sequence B
  ENSP ID: ENSP00000407092
MGLGRVLLFLAVAFPFAPPAAAAEPHSLRYNLMVLSQDGSVQSGFLAEGHLDGQPFLRYDRQKRRAKPQGQWAEDVLGAETWDTETEDLTENGQDLRRTLTHIKDQKGGLHSLQEIRVCEMHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 51255 - protein, 383 aa, Homo sapiens; identical to SEQ ID NO: 51242
  Payload ID: 10222
  Gene Symbol: MICB
  Gene Name: MHC class I polypeptide-related sequence B
  ENSP ID: ENSP00000407561

SEQ ID NO: 51256 - protein, 340 aa, Homo sapiens; identical to SEQ ID NO: 51245
  Payload ID: 10222
  Gene Symbol: MICB
  Gene Name: MHC class I polypeptide-related sequence B
  ENSP ID: ENSP00000409347

SEQ ID NO: 51257 - protein, 340 aa, Homo sapiens; identical to SEQ ID NO: 51249
  Payload ID: 10222
  Gene Symbol: MICB
  Gene Name: MHC class I polypeptide-related sequence B
  Uniprot ID: Q29980
  ENSP ID: ENSP00000409414

SEQ ID NO: 51258 - protein, 351 aa, Homo sapiens
  Payload ID: 10222
  Gene Symbol: MICB
  Gene Name: MHC class I polypeptide-related sequence B
  ENSP ID: ENSP00000442345
MVLSQDGSVQSGFLAEGHLDGQPFLRYDRQKRRAKPQGQWAENVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 51259 - protein, 351 aa, Homo sapiens; identical to SEQ ID NO: 51258
  Payload ID: 10222
  Gene Symbol: MICB
  Gene Name: MHC class I polypeptide-related sequence B
  ENSP ID: ENSP00000477804

SEQ ID NO: 51260 - protein, 383 aa, Homo sapiens
  Payload ID: 10222
  Gene Symbol: MICB
  Gene Name: MHC class I polypeptide-related sequence B
  ENSP ID: ENSP00000482246
MGLGPVFLLLAGIFPFAPPGAAAEPHSLRYNLMVLSQDGSVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 51261 - protein, 131 aa, Homo sapiens
  Payload ID: 10223
  Gene Symbol: MIA-RAB4B
  Gene Name: MIA-RAB4B readthrough (NMD candidate)
  ENSP ID: ENSP00000472384
MARSLVCLGVIILLSAFSGPGVRGGPMPKLADRKLCADQECSHPISMAVALQDYMAPDCRFLTIHRGQVVYVFSKLKGRGRLFWGGSVQGDYYGDLAARLGYFPSSIVREDQTLKPGKVDVKTDTSSSNSW

SEQ ID NO: 51262 - protein, 695 aa, Homo sapiens
  Payload ID: 10224
  Gene Symbol: MICALCL
  Gene Name: MICAL C-terminal like
  Uniprot ID: Q6ZW33
  ENSP ID: ENSP00000256186
MSPPKDPSPSLPLPSSSSHSSSPPSSSSTSVSGNAPDGSSPPQMTASEPLSQVSRGHPSPPTPNFRRRAVAQGAPREIPLYLPHHPKPEWAEYCLVSPGEDGLSDPAEMTSDECQPAEAPLGDIGSNHRDPHPIWGKDRSWTGQELSPLAGEDREKGSTGARKEEEGGPVLVKEKLGLKKLVLTQEQKTMLLDWNDSIPESVHLKAGERISQKSAENGRGGRVLKPVRPLLLPRAAGEPLPTQRGAQEKMGTPAEQAQGERNVPPPKSPLRLIANAIRRSLEPLLSNSEGGKKAWAKQESKTLPAQACTRSFSLRKTNSNKDGDQHSPGRNQSSAFSPPDPALRTHSLPNRPSKVFPALRSPPCSKIEDVPTLLEKVSLQENFPDASKPPKKRISLFSSLRLKDKSFESFLQESRQRKDIRDLFGSPKRKVLPEDSAQALEKLLQPFKSTSLRQAAPPPPPPPPPPPPPPTAGGADSKNFPLRAQVTEASSSASSTSSSSADEEFDPQLSLQLKEKKTLRRRKKLEKAMKQLVKQEELKRLYKAQAIQRQLEEVEERQRASEIQGVRLEKALRGEADSGTQDEAQLLQEWFKLVLEKNKLMRYESELLIMAQELELEDHQSRLEQKLREKMLKEESQKDEKDLNEEQEVFTELMQVIEQRDKLVDSLEEQRIREKAEDQHFESFVFSRGCQLSRT

SEQ ID NO: 51263 - protein, 29 aa, Homo sapiens
  Payload ID: 10224
  Gene Symbol: MICALCL
  Gene Name: MICAL C-terminal like
  ENSP ID: ENSP00000432324
MSPPKDPSPSLPLPSSSSHSSSPPSSSST

SEQ ID NO: 51264 - protein, 863 aa, Homo sapiens
  Payload ID: 10225
  Gene Symbol: MICALL1
  Gene Name: MICAL-like 1
  Uniprot ID: Q8N3F8
  ENSP ID: ENSP00000215957
MAGPRGALLAWCRRQCEGYRGVEIRDLSSSFRDGLAFCAILHRHRPDLLDFDSLSKDNVFENNRLAFEVAEKELGIPALLDPNDMVSMSVPDCLSIMTYVSQYYNHFCSPGQAGVSPPRKGLAPCSPPSVAPTPVEPEDVAQGEELSSGSLSEQGTGQTPSSTCAACQQHVHLVQRYLADGRLYHRHCFRCRRCSSTLLPGAYENGPEEGTFVCAEHCARLGPGTRSGTRPGPFSQPKQQHQQQLAEDAKDVPGGGPSSSAPAGAEADGPKASPEARPQIPTKPRVPGKLQELASPPAGRPTPAPRKASESTTPAPPTPRPRSSLQQENLVEQAGSSSLVNGRLHELPVPKPRGTPKPSEGTPAPRKDPPWITLVQAEPKKKPAPLPPSSSPGPPSQDSRQVENGGTEEVAQPSPTASLESKPYNPFEEEEEDKEEEAPAAPSLATSPALGHPESTPKSLHPWYGITPTSSPKTKKRPAPRAPSASPLALHASRLSHSEPPSATPSPALSVESLSSESASQTAGAELLEPPAVPKSSSEPAVHAPGTPGNPVSLSTNSSLASSGELVEPRVEQMPQASPGLAPRTRGSSGPQPAKPCSGATPTPLLLVGDRSPVPSPGSSSPQLQVKSSCKENPFNRKPSPAASPATKKATKGSKPVRPPAPGHGFPLIKRKVQADQYIPEEDIHGEMDTIERRLDALEHRGVLLEEKLRGGLNEGREDDMLVDWFKLIHEKHLLVRRESELIYVFKQQNLEQRQADVEYELRCLLNKPEKDWTEEDRAREKVLMQELVTLIEQRNAIINCLDEDRQREEEEDKMLEAMIKKKEFQREAEPEGKKKGKFKTMKMLKLLGNKRDAKSKSPRDKS

SEQ ID NO: 51265 - protein, 210 aa, Homo sapiens
  Payload ID: 10225
  Gene Symbol: MICALL1
  Gene Name: MICAL-like 1
  ENSP ID: ENSP00000404543
MVSMSVPDCLSIMTYVSQYYNHFCSPGQAGVSPPRKGLAPCSPPSVAPTPVEPEDVAQGEELSSGSLSEQGTGQTPSSTCAACQQHVHLVQRYLADGRLYHRHCFRCRRCSSTLLPGAYENGPEEGTFVCAEHCARLGPGTRSGTRPGPFSQPKQQHQQQLAEDAKDVPGGGPSSSAPAGAEADGPKASPEARPQIPTKPRVPGKLQELA

SEQ ID NO: 51266 - protein, 370 aa, Homo sapiens
  Payload ID: 10225
  Gene Symbol: MICALL1
  Gene Name: MICAL-like 1
  ENSP ID: ENSP00000406053
  MOD_RES (1)..(1): Any amino acid
XYNPFEEEEEDKEEEAPAAPSLATSPALGHPESTPKSLHPWYGITPTSSPKTKKRPAPRAPSASPLALHASRLSHSEPPSATPSPALSVESLSSESASQTAGAELLEPPAVPKSSSEPAVHAPGTPGNPVSLSTNSSLASSGELVEPRVEQMPQASPGLAPRTRGSSGPQPAKPCSGATPTPLLLVGDRSPVPSPGSSSPQLQSSCKENPFNRKPSPAASPATKKATKGSKPVRPPAPGHGFPLIKRKVQADQYIPEEDIHGEMDTIERRLDALEHRGVLLEEKLRGGLNEGREDDMLVDWFKLIHEKHLLVRRESELIYVFKQQNLEQRQADVEYELRCLLNKPEKDWTEEDRAREKVLMQELVTLIEQ

SEQ ID NO: 51267 - protein, 186 aa, Homo sapiens
  Payload ID: 10225
  Gene Symbol: MICALL1
  Gene Name: MICAL-like 1
  ENSP ID: ENSP00000416766
EMDTIERRLDALEHRGVLLEEKLRGGLNEGREDDMLVDWFKLIHEKHLLVRRESELIYVFKQQNLEQRQADVEYELRCLLNKPEKDWTEEDRAREKVLMQELVTLIEQRNAIINCLDEDRQREEEEDKMLEAMIKKKGEALAGDEAEFQREAEPEGKKKGKFKTMKMLKLLGNKRDAKSKSPRDKS

SEQ ID NO: 51268 - protein, 904 aa, Homo sapiens
  Payload ID: 10226
  Gene Symbol: MICALL2
  Gene Name: MICAL-like 2
  Uniprot ID: Q8IY33
  ENSP ID: ENSP00000297508
MAAIRALQQWCRQQCEGYRDVNICNMTTSFRDGLAFCAILHRHRPDLINFSALKKENIYENNKLAFRVAEEHLGIPALLDAEDMVALKVPDRLSILTYVSQYYNYFHGRSPIGGMAGVKRASEDSEEEPSGKKAPVQAAKLPSPAPARKPPLSPAQTNPVVQRRNEGAGGPPPKTDQALAGSLVSSTCGVCGKHVHLVQRHLADGRLYHRSCFRCKQCSCTLHSGAYKATGEPGTFVCTSHLPAAASASPKLTGLVPRQPGAMGVDSRTSCSPQKAQEANKARPSAWEPAAGNSPARASVPAAPNPAATSATSVHVRSPARPSESRLAPTPTEGKVRPRVTNSSPMGWSSAAPCTAAAASHPAVPPSAPDPRPATPQGGGAPRVAAPQTTLSSSSTSAATVDPPAWTPSASRTQQARNKFFQTSAVPPGTSLSGRGPTPSLVLSKDSSKEQARNFLKQALSALEEAGAPAPGRPSPATAAVPSSQPKTEAPQASPLAKPLQSSSPRVLGLPSRMEPPAPLSTSSTSQASALPPAGRRNLAESSGVGRVGAGSRPKPEAPMAKGKSTTLTQDMSTSLQEGQEDGPAGWRANLKPVDRRSPAERTLKPKEPRALAEPRAGEAPRKVSGSFAGSVHITLTPVRPDRTPRPASPGPSLPARSPSPPRRRRLAVPASLDVCDNWLRPEPPGQEARVQSWKEEEKKPHLQGKPGRPLSPANVPALPGETVTSPVRLHPDYLSPEEIQRQLQDIERRLDALELRGVELEKRLRAAEGDDAEDSLMVDWFWLIHEKQLLLRQESELMYKSKAQRLEEQQLDIEGELRRLMAKPEALKSLQERRREQELLEQYVSTVNDRSDIVDSLDEDRLREQEEDQMLRDMIEKLGLQRKKSKFRLSKIWSPKSKSSPSQ

SEQ ID NO: 51269 - protein, 680 aa, Homo sapiens
  Payload ID: 10226
  Gene Symbol: MICALL2
  Gene Name: MICAL-like 2
  Uniprot ID: Q8IY33
  ENSP ID: ENSP00000405415
MFLSSRNFSALKKENIYENNKLAFRVAEEHLGIPALLDAEDMVALKVPDRLSILTYVSQYYNYFHGRSPIGGMAGVKRASEDSEEEPSGKKAPVQAAKLPSPAPARKPPLSPAQTNPVVQRRNEGAGGPPPKTDQALAGSLVSSTCGVCGKHVHLVQRHLADGRLYHRSCFRCKQCSCTLHSGAYKATGEPGTFVCTSHLPAAASASPKLTGLVPRQPGAMGVDSRTSCSPQKAQEANKARPSAWEPAAGNSPARASVPAAPNPAATSATSVHVRSPARPSESRLAPTPTEGKVRPRVTNSSPMGWSSAAPCTAAAASHPAVPPSAPDPRPATPQGGGAPRVAAPQTTLSSSSTSAATVDPPAWTPSASRTQQARNKFFQTSAVPPGTSLSGRGPTPSLVLSKDSSKEQARNFLKQALSALEEAGAPAPGRPSPATAAVPSSQPKTEAPQASPLAKPLQSSSPRVLGLPSRMEPPAPLSTSSTSQASALPPAGRRNLAESSGVGRVGAGSRPKPEAPMAKGKSTTLTQDMSTSLQEGQEDGPAGWRANLKPVDRRSPAERTLKPKEPRALAEPRAGEAPRKVSGSFAGSVHITLTPVRPDRTPRPASPGPSLPGPPPHPAAGDWPSLPASTFVTTGFGRSPLARKPECRAGRRRRRNLTFRANQGDPCPRPMSLLCLARR

SEQ ID NO: 51270 - protein, 835 aa, Homo sapiens
  Payload ID: 10227
  Gene Symbol: MCPH1
  Gene Name: microcephalin 1
  ENSP ID: ENSP00000342924
MAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLDDDVPILLFESNGSLIYTPTIEINSRHHSAMEKRLQEMKEKRENLSPTSSQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPDQKQAAGMSQETFEEKYRLSPTLSSTKGHLLIHSRPRSSSVKRKRVSHGSHSPPKEKCKRKRSTRRSIMPRLQLCRSEDRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSVKNRPTRHDVLDDSCDGFKDLIKPHEELKKSGRGKKPTRTLVMTSMPSEKQNVVIQVVDKLKGFSIAPDVCETTTHVLSGKPLRTLNVLLGIARGCWVLSYDWVLWSLELGHWISEEPFELSHHFPAAPLCRSECHLSAGPYRGTLFADQPAMFVSPASSPPVAKLCELVHLCGGRVSQVPRQASIVIGPYSGKKKATVKYLSEKWVLDSITQHKVCAPENYLLSQ

SEQ ID NO: 51271 - protein, 562 aa, Homo sapiens
  Payload ID: 10227
  Gene Symbol: MCPH1
  Gene Name: microcephalin 1
  Uniprot ID: Q8NEM0
  ENSP ID: ENSP00000430768
MAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLASQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPDQKQAAGMSQETFEEKYRLSPTLSSTKGHLLIHSRPRSSSVKRKRVSHGSHSPPKEKCKRKRSTRRSIMPRLQLCRSEDRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSM

SEQ ID NO: 51272 - protein, 610 aa, Homo sapiens
  Payload ID: 10227
  Gene Symbol: MCPH1
  Gene Name: microcephalin 1
  Uniprot ID: Q8NEM0
  ENSP ID: ENSP00000430962
MAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLDDDVPILLFESNGSLIYTPTIEINSRHHSAMEKRLQEMKEKRENLSPTSSQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPDQKQAAGMSQETFEEKYRLSPTLSSTKGHLLIHSRPRSSSVKRKRVSHGSHSPPKEKCKRKRSTRRSIMPRLQLCRSEDRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSM

SEQ ID NO: 51273 - protein, 173 aa, Homo sapiens
  Payload ID: 10228
  Gene Symbol: MFAP5
  Gene Name: microfibrillar associated protein 5
  Uniprot ID: Q13361
  ENSP ID: ENSP00000352455
MSLLGPKVLLFLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 51274 - protein, 163 aa, Homo sapiens
  Payload ID: 10228
  Gene Symbol: MFAP5
  Gene Name: microfibrillar associated protein 5
  Uniprot ID: Q13361
  ENSP ID: ENSP00000379798
MSLLGPKVLLFLAAFIITSDWIPLGVNSQRGDDVTQATPETFTEDPNLVNDPATDETVLAVLADIAPSTDDLECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 51275 - protein, 148 aa, Homo sapiens
  Payload ID: 10228
  Gene Symbol: MFAP5
  Gene Name: microfibrillar associated protein 5
  ENSP ID: ENSP00000411997
MSLLGPKVLLFLAAFIITSDWIPLGVNSQRGDDVTQATPETFTEDPNLVNDPATDETECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 51276 - protein, 109 aa, Homo sapiens
  Payload ID: 10228
  Gene Symbol: MFAP5
  Gene Name: microfibrillar associated protein 5
  ENSP ID: ENSP00000438525
MSLLGPKVLLFLAAFIITSDWIPLGVNSQRGDDVTQATPETFTEDPNLVNDPATDETVLAVLADIAPSTDDLDELCRQMAGLPPRRLRRSNYFRLPPCENVDLQRPNGL

SEQ ID NO: 51277 - protein, 138 aa, Homo sapiens
  Payload ID: 10228
  Gene Symbol: MFAP5
  Gene Name: microfibrillar associated protein 5
  ENSP ID: ENSP00000439289
MSLLGPKVLLFLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDP

SEQ ID NO: 51278 - protein, 163 aa, Homo sapiens; identical to SEQ ID NO: 51274
  Payload ID: 10228
  Gene Symbol: MFAP5
  Gene Name: microfibrillar associated protein 5
  Uniprot ID: Q13361
  ENSP ID: ENSP00000440496

SEQ ID NO: 51279 - protein, 163 aa, Homo sapiens
  Payload ID: 10228
  Gene Symbol: MFAP5
  Gene Name: microfibrillar associated protein 5
  ENSP ID: ENSP00000441185
  MOD_RES (1)..(1): Any amino acid
XLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 51280 - protein, 151 aa, Homo sapiens
  Payload ID: 10228
  Gene Symbol: MFAP5
  Gene Name: microfibrillar associated protein 5
  ENSP ID: ENSP00000441492
MSLLGPKVLLFLAAFIITSDDVTQATPETFTEDPNLVNDPATDETVLAVLADIAPSTDDLECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 51281 - protein, 128 aa, Homo sapiens
  Payload ID: 10228
  Gene Symbol: MFAP5
  Gene Name: microfibrillar associated protein 5
  ENSP ID: ENSP00000443839
MSLLGPKVLLFLAAFIITSDWIPLGVNSQRGDDVTQATPETFTEDPNLVNDPATDETVLAVLADIAPSTDDLECWDEKFTCTRLYSVHRPVKQCIHQLCFTSLRRMYIVNKEICSRLVCKEHEAMKDP

SEQ ID NO: 51282 - protein, 79 aa, Homo sapiens
  Payload ID: 10228
  Gene Symbol: MFAP5
  Gene Name: microfibrillar associated protein 5
  ENSP ID: ENSP00000444531
YSVHRPVKQCIHQLCFTSLRRMYIVNKEICSRLVCKEHEAMKDELCRQMAGLPPRRLRRSNYFRLPPCENVDLQRPNGL

SEQ ID NO: 51283 - protein, 91 aa, Homo sapiens
  Payload ID: 10228
  Gene Symbol: MFAP5
  Gene Name: microfibrillar associated protein 5
  ENSP ID: ENSP00000445799
MSLLGPKVLLFLAAFIITSDWIPLGVNSQRGDDVTQATPETFTEDPNLVNDPATDETVLAVLADIAPSTDDLASLSEKNTTAECWDEKFTC

SEQ ID NO: 51284 - protein, 439 aa, Homo sapiens
  Payload ID: 10229
  Gene Symbol: MFAP1
  Gene Name: microfibrillar-associated protein 1
  Uniprot ID: P55081
  ENSP ID: ENSP00000267812
MSVPSALMKQPPIQSTAGAVPVRNEKGEISMEKVKVKRYVSGKRPDYAPMESSDEEDEEFQFIKKAKEQEAEPEEQEEDSSSDPRLRRLQNRISEDVEERLARHRKIVEPEVVGESDSEVEGDAWRMEREDSSEEEEEEIDDEEIERRRGMMRQRAQERKNEEMEVMEVEDEGRSGEESESESEYEEYTDSEDEMEPRLKPVFIRKKDRVTVQEREAEALKQKELEQEAKRMAEERRKYTLKIVEEETKKELEENKRSLAALDALNTDDENDEEEYEAWKVRELKRIKRDREDREALEKEKAEIERMRNLTEEERRAELRANGKVITNKAVKGKYKFLQKYYHRGAFFMDEDEEVYKRDFSAPTLEDHFNKTILPKVMQVKNFGRSGRTKYTHLVDQDTTSFDSAWGQESAQNTKFFKQKAAGVRDVFERPSAKKRKTT

SEQ ID NO: 51285 - protein, 182 aa, Homo sapiens
  Payload ID: 10230
  Gene Symbol: MFAP2
  Gene Name: microfibrillar-associated protein 2
  Uniprot ID: P55001
  ENSP ID: ENSP00000364684
MRAAYLFLLFLPGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 51286 - protein, 183 aa, Homo sapiens
  Payload ID: 10230
  Gene Symbol: MFAP2
  Gene Name: microfibrillar-associated protein 2
  Uniprot ID: P55001
  ENSP ID: ENSP00000364685
MRAAYLFLLFLPAGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 51287 - protein, 362 aa, Homo sapiens
  Payload ID: 10231
  Gene Symbol: MFAP3
  Gene Name: microfibrillar-associated protein 3
  Uniprot ID: P55082
  ENSP ID: ENSP00000322956
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYTCFVTSPIRASYSVTLRVIFTSGDMSVYYMIVCLIAFTITLILNVTRLCMMSSHLRKTEKAINEFFRTEGAEKLQKAFEIAKRIPIITSAKTLELAKVTQFKTMEFARYIEELARSVPLPPLILNCRAFVEEMFEAVRVDDPDDLGERIKERPALNAQGGIYVINPEMGRSNSPGGDSDDGSLNEQGQEIAVQVSVHLQSETKSIDTESQGSSHFSPPDDIGSAESNCNYKDGAYENCQL

SEQ ID NO: 51288 - protein, 216 aa, Homo sapiens
  Payload ID: 10231
  Gene Symbol: MFAP3
  Gene Name: microfibrillar-associated protein 3
  Uniprot ID: P55082
  ENSP ID: ENSP00000414219
MSVYYMIVCLIAFTITLILNVTRLCMMSSHLRKTEKAINEFFRTEGAEKLQKAFEIAKRIPIITSAKTLELAKVTQFKTMEFARYIEELARSVPLPPLILNCRAFVEEMFEAVRVDDPDDLGERIKERPALNAQGGIYVINPEMGRSNSPGGDSDDGSLNEQGQEIAVQVSVHLQSETKSIDTESQGSSHFSPPDDIGSAESNCNYKDGAYENCQL

SEQ ID NO: 51289 - protein, 16 aa, Homo sapiens
  Payload ID: 10231
  Gene Symbol: MFAP3
  Gene Name: microfibrillar-associated protein 3
  ENSP ID: ENSP00000430007
MKLHCCLFTLVASIIV

SEQ ID NO: 51290 - protein, 109 aa, Homo sapiens
  Payload ID: 10231
  Gene Symbol: MFAP3
  Gene Name: microfibrillar-associated protein 3
  ENSP ID: ENSP00000430602
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFL

SEQ ID NO: 51291 - protein, 123 aa, Homo sapiens
  Payload ID: 10231
  Gene Symbol: MFAP3
  Gene Name: microfibrillar-associated protein 3
  ENSP ID: ENSP00000430852
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYT

SEQ ID NO: 51292 - protein, 409 aa, Homo sapiens
  Payload ID: 10232
  Gene Symbol: MFAP3L
  Gene Name: microfibrillar-associated protein 3-like
  Uniprot ID: O75121
  ENSP ID: ENSP00000354583
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 51293 - protein, 102 aa, Homo sapiens
  Payload ID: 10232
  Gene Symbol: MFAP3L
  Gene Name: microfibrillar-associated protein 3-like
  Uniprot ID: O75121
  ENSP ID: ENSP00000377305
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGRL

SEQ ID NO: 51294 - protein, 306 aa, Homo sapiens
  Payload ID: 10232
  Gene Symbol: MFAP3L
  Gene Name: microfibrillar-associated protein 3-like
  Uniprot ID: O75121
  ENSP ID: ENSP00000377307
MHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 51295 - protein, 102 aa, Homo sapiens; identical to SEQ ID NO: 51293
  Payload ID: 10232
  Gene Symbol: MFAP3L
  Gene Name: microfibrillar-associated protein 3-like
  Uniprot ID: O75121
  ENSP ID: ENSP00000422571

SEQ ID NO: 51296 - protein, 156 aa, Homo sapiens
  Payload ID: 10232
  Gene Symbol: MFAP3L
  Gene Name: microfibrillar-associated protein 3-like
  ENSP ID: ENSP00000422791
MHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIME

SEQ ID NO: 51297 - protein, 73 aa, Homo sapiens
  Payload ID: 10232
  Gene Symbol: MFAP3L
  Gene Name: microfibrillar-associated protein 3-like
  ENSP ID: ENSP00000423549
MDRLKSHLTVCFLPSVPFLILVSTLATAKSVTNSTLNGTNVVLGSVPVIIARTDHIIVKEGNSALINCSVYGI

SEQ ID NO: 51298 - protein, 63 aa, Homo sapiens
  Payload ID: 10232
  Gene Symbol: MFAP3L
  Gene Name: microfibrillar-associated protein 3-like
  ENSP ID: ENSP00000423722
MHDSGLLNITKVSFSDRGKYTCVASNIYGTVNNTVTLRVIFTSGDMGVYYMVVCLVAFTIVMV

SEQ ID NO: 51299 - protein, 44 aa, Homo sapiens
  Payload ID: 10232
  Gene Symbol: MFAP3L
  Gene Name: microfibrillar-associated protein 3-like
  ENSP ID: ENSP00000423802
MHDSGLLNITKVSFSDRGKYTCVASNIYGTVNNTVTLRVIFTSG

SEQ ID NO: 51300 - protein, 98 aa, Homo sapiens
  Payload ID: 10232
  Gene Symbol: MFAP3L
  Gene Name: microfibrillar-associated protein 3-like
  ENSP ID: ENSP00000425303
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERG

SEQ ID NO: 51301 - protein, 90 aa, Homo sapiens
  Payload ID: 10232
  Gene Symbol: MFAP3L
  Gene Name: microfibrillar-associated protein 3-like
  ENSP ID: ENSP00000426247
MDRLKSHLTVCFLPSVPFLILVSTLATAKSVTNSTLNGTNVVLGSVPVIIARTDHIIVKEGNSALINCSVYGIPDPQFKWYNSIGKLLKE

SEQ ID NO: 51302 - protein, 255 aa, Homo sapiens
  Payload ID: 10233
  Gene Symbol: MFAP4
  Gene Name: microfibrillar-associated protein 4
  Uniprot ID: P55083
  ENSP ID: ENSP00000299610
MKALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 51303 - protein, 279 aa, Homo sapiens
  Payload ID: 10233
  Gene Symbol: MFAP4
  Gene Name: microfibrillar-associated protein 4
  Uniprot ID: P55083
  ENSP ID: ENSP00000378957
MGELSPLQRPLATEGTMKAQGVLLKLALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 51304 - protein, 280 aa, Homo sapiens
  Payload ID: 10233
  Gene Symbol: MFAP4
  Gene Name: microfibrillar-associated protein 4
  ENSP ID: ENSP00000468578
MVGANAKRTGDLWSWEGAVLTLSAHRQALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 51305 - protein, 520 aa, Homo sapiens
  Payload ID: 10234
  Gene Symbol: MITF
  Gene Name: microphthalmia-associated transcription factor
  Uniprot ID: O75030
  ENSP ID: ENSP00000295600
MQSESGIVPDFEVGEEFHEEPKTYYELKSQPLKSSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 51306 - protein, 413 aa, Homo sapiens
  Payload ID: 10234
  Gene Symbol: MITF
  Gene Name: microphthalmia-associated transcription factor
  Uniprot ID: O75030
  ENSP ID: ENSP00000324246
MLEMLEYNHYQVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 51307 - protein, 504 aa, Homo sapiens
  Payload ID: 10234
  Gene Symbol: MITF
  Gene Name: microphthalmia-associated transcription factor
  Uniprot ID: O75030
  ENSP ID: ENSP00000324443
MEALRVQMFMPCSFESLYLSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 51308 - protein, 519 aa, Homo sapiens
  Payload ID: 10234
  Gene Symbol: MITF
  Gene Name: microphthalmia-associated transcription factor
  Uniprot ID: O75030
  ENSP ID: ENSP00000327867
MGHLENTSVVFPRAIFSLCEKETRKLTLCLFSRSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 51309 - protein, 419 aa, Homo sapiens
  Payload ID: 10234
  Gene Symbol: MITF
  Gene Name: microphthalmia-associated transcription factor
  Uniprot ID: O75030
  ENSP ID: ENSP00000377880
MLEMLEYNHYQVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 51310 - protein, 117 aa, Homo sapiens
  Payload ID: 10234
  Gene Symbol: MITF
  Gene Name: microphthalmia-associated transcription factor
  ENSP ID: ENSP00000391276
MGHLENTSVVFPRAIFSLCEKETRKLTLCLFSRSSSAEHPGASKPPISSSSMTSRILLRQQLMREQMQEQERREQQQKLQAAQFMQQRVPVSQTPAINVSVPTTLPSATQVPMEVLK

SEQ ID NO: 51311 - protein, 526 aa, Homo sapiens
  Payload ID: 10234
  Gene Symbol: MITF
  Gene Name: microphthalmia-associated transcription factor
  Uniprot ID: O75030
  ENSP ID: ENSP00000391803
MQSESGIVPDFEVGEEFHEEPKTYYELKSQPLKSSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 51312 - protein, 361 aa, Homo sapiens
  Payload ID: 10234
  Gene Symbol: MITF
  Gene Name: microphthalmia-associated transcription factor
  ENSP ID: ENSP00000398639
MEALRVQMFMPCSFESLYLSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENR

SEQ ID NO: 51313 - protein, 70 aa, Homo sapiens
  Payload ID: 10234
  Gene Symbol: MITF
  Gene Name: microphthalmia-associated transcription factor
  ENSP ID: ENSP00000407620
MTSRILLRQQLMREQMQEQERREQQQKLQAAQFMQQRVPVSQTPAINVSVPTTLPSATQVPMEVLKVQTH

SEQ ID NO: 51314 - protein, 157 aa, Homo sapiens
  Payload ID: 10234
  Gene Symbol: MITF
  Gene Name: microphthalmia-associated transcription factor
  ENSP ID: ENSP00000411389
MTSRILLRQQLMREQMQEQERREQQQKLQAAQFMQQRVPVSQTPAINVSVPTTLPSATQVPMEVLKVQTHLENPTKYHIQQAQRQQGFYKFEEQNRAESECPGMNTHSRASCMQMDDVIDDIISLESSYNEEILGLMDPALQMANTLPVSGNLIDLY

SEQ ID NO: 51315 - protein, 468 aa, Homo sapiens
  Payload ID: 10234
  Gene Symbol: MITF
  Gene Name: microphthalmia-associated transcription factor
  Uniprot ID: O75030
  ENSP ID: ENSP00000418845
MTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 51316 - protein, 105 aa, Homo sapiens
  Payload ID: 10234
  Gene Symbol: MITF
  Gene Name: microphthalmia-associated transcription factor
  ENSP ID: ENSP00000433487
MLEMLEYNHYQVQTHLENPTKYHIQQAQRQQVKQYLSTTLANKHANQVLSLPCPNQPGDHVMPPVPGSSAPNSPMAMLTLNSNCEKEGFYKFEEQNRAESECPDG

SEQ ID NO: 51317 - protein, 357 aa, Homo sapiens
  Payload ID: 10234
  Gene Symbol: MITF
  Gene Name: microphthalmia-associated transcription factor
  Uniprot ID: O75030
  ENSP ID: ENSP00000435909
MLEMLEYNHYQVQTHLENPTKYHIQQAQRQQGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 51318 - protein, 91 aa, Homo sapiens
  Payload ID: 10234
  Gene Symbol: MITF
  Gene Name: microphthalmia-associated transcription factor
  ENSP ID: ENSP00000481286
MLEMLEYNHYQVQTHLENPTKYHIQQAQRQQVKQYLSTTLANKHANQVLSLPCPNQPGDHVMPPVPGSSAPNSPMAMLTLNSNCEKEFMKQ

SEQ ID NO: 51319 - protein, 77 aa, Homo sapiens
  Payload ID: 10235
  Gene Symbol: MSMB
  Gene Name: microseminoprotein, beta-
  Uniprot ID: P08118
  ENSP ID: ENSP00000462641
MNVLLGSVVIFATFVTLCNASCYFIPNEGVPGDSTRMFLHLWVMTKTTAKESSRRRTASISWWRRRTQKRPVLSVNG

SEQ ID NO: 51320 - protein, 114 aa, Homo sapiens
  Payload ID: 10235
  Gene Symbol: MSMB
  Gene Name: microseminoprotein, beta-
  Uniprot ID: P08118
  ENSP ID: ENSP00000463092
MNVLLGSVVIFATFVTLCNASCYFIPNEGVPGDSTRKCMDLKGNKHPINSEWQTDNCETCTCYETEISCCTLVSTPVGYDKDNCQRIFKKEDCKYIVVEKKDPKKTCSVSEWII

SEQ ID NO: 51321 - protein, 139 aa, Homo sapiens
  Payload ID: 10236
  Gene Symbol: MSMP
  Gene Name: microseminoprotein, prostate associated
  Uniprot ID: Q1L6U9
  ENSP ID: ENSP00000419194
MALRMLWAGQAKGILGGWGIICLVMSLLLQHPGVYSKCYFQAQAPCHYEGKYFTLGESWLRKDCFHCTCLHPVGVGCCDTSQHPIDFPAGCEVRQEAGTCQFSLVQKSDPRLPCKGGGPDPEWGSANTPVPGAPAPHSS

SEQ ID NO: 51322 - protein, 155 aa, Homo sapiens
  Payload ID: 10237
  Gene Symbol: MGST1
  Gene Name: microsomal glutathione S-transferase 1
  Uniprot ID: P10620
  ENSP ID: ENSP00000010404
MVDLTQVMDDEVFMAFASYATIILSKMMLMSTATAFYRLTRKVFANPEDCVAFGKGENAKKYLRTDDRVERVRRAHLNDLENIIPFLGIGLLYSLSGPDPSTAILHFRLFVGARIYHTIAYLTPLPQPNRALSFFVGYGVTLSMAYRLLKSKLYL

SEQ ID NO: 51323 - protein, 155 aa, Homo sapiens; identical to SEQ ID NO: 51322
  Payload ID: 10237
  Gene Symbol: MGST1
  Gene Name: microsomal glutathione S-transferase 1
  Uniprot ID: P10620
  ENSP ID: ENSP00000379510

SEQ ID NO: 51324 - protein, 155 aa, Homo sapiens; identical to SEQ ID NO: 51322
  Payload ID: 10237
  Gene Symbol: MGST1
  Gene Name: microsomal glutathione S-transferase 1
  Uniprot ID: P10620
  ENSP ID: ENSP00000379512

SEQ ID NO: 51325 - protein, 155 aa, Homo sapiens; identical to SEQ ID NO: 51322
  Payload ID: 10237
  Gene Symbol: MGST1
  Gene Name: microsomal glutathione S-transferase 1
  Uniprot ID: P10620
  ENSP ID: ENSP00000379513

SEQ ID NO: 51326 - protein, 46 aa, Homo sapiens
  Payload ID: 10237
  Gene Symbol: MGST1
  Gene Name: microsomal glutathione S-transferase 1
  ENSP ID: ENSP00000437988
MVDLTQVMDDEVFMAFASYATIILSKMMLMSTATAFYRLTRKSPPE

SEQ ID NO: 51327 - protein, 87 aa, Homo sapiens
  Payload ID: 10237
  Gene Symbol: MGST1
  Gene Name: microsomal glutathione S-transferase 1
  Uniprot ID: P10620
  ENSP ID: ENSP00000438308
MVDLTQVMDDEVFMAFASYATIILSKMMLMSTATAFYRLTRKVFANPEDCVAFGKGENAKKYLRTDDRVERVRRIKQTLSIYLASSI

SEQ ID NO: 51328 - protein, 42 aa, Homo sapiens
  Payload ID: 10237
  Gene Symbol: MGST1
  Gene Name: microsomal glutathione S-transferase 1
  ENSP ID: ENSP00000440443
MVDLTQVMDDEVFMAFASYATIILSKMMLMSTATAFYRLTRK

SEQ ID NO: 51329 - protein, 77 aa, Homo sapiens
  Payload ID: 10237
  Gene Symbol: MGST1
  Gene Name: microsomal glutathione S-transferase 1
  ENSP ID: ENSP00000442557
MVDLTQVMDDEVFMAFASYATIILSKMMLMSTATAFYRLTRKVFANPEDCVAFGKGENAKKYLRTDDRVERVRRAHL

SEQ ID NO: 51330 - protein, 106 aa, Homo sapiens
  Payload ID: 10237
  Gene Symbol: MGST1
  Gene Name: microsomal glutathione S-transferase 1
  ENSP ID: ENSP00000442767
MVDLTQVFANPEDCVAFGKGENAKKYLRTDDRVERVRRAHLNDLENIIPFLGIGLLYSLSGPDPSTAILHFRLFVGARIYHTIAYLTPLPQPNRALSFFVGYGVTL

SEQ ID NO: 51331 - protein, 80 aa, Homo sapiens
  Payload ID: 10237
  Gene Symbol: MGST1
  Gene Name: microsomal glutathione S-transferase 1
  ENSP ID: ENSP00000442970
MVDLTQVMDDEVFMAFASYATIILSKMMLMSTATAFYRLTRKVFANPEDCVAFGKGENAKKYLRTDDRVERVRRAHLNDL

SEQ ID NO: 51332 - protein, 147 aa, Homo sapiens
  Payload ID: 10238
  Gene Symbol: MGST2
  Gene Name: microsomal glutathione S-transferase 2
  Uniprot ID: Q99735
  ENSP ID: ENSP00000265498
MAGNSILLAAVSILSACQQSYFALQVGKARLKYKVTPPAVTGSPEFERVFRAQQNCVEFYPIFIITLWMAGWYFNQVFATCLGLVYIYGRHLYFWGYSEAAKKRITGFRLSLGILALLTLLGALGIANSFLDEYLDLNIAKKLRRQF

SEQ ID NO: 51333 - protein, 147 aa, Homo sapiens; identical to SEQ ID NO: 51332
  Payload ID: 10238
  Gene Symbol: MGST2
  Gene Name: microsomal glutathione S-transferase 2
  Uniprot ID: Q99735
  ENSP ID: ENSP00000423008

SEQ ID NO: 51334 - protein, 77 aa, Homo sapiens
  Payload ID: 10238
  Gene Symbol: MGST2
  Gene Name: microsomal glutathione S-transferase 2
  Uniprot ID: Q99735
  ENSP ID: ENSP00000424278
MAGNSILLAAVSILSACQQSYFALQVGKARLKYKVTPPAVTGSPEFERVFRAHFCYLSGSGVHIWPSPILLGIFRSC

SEQ ID NO: 51335 - protein, 147 aa, Homo sapiens; identical to SEQ ID NO: 51332
  Payload ID: 10238
  Gene Symbol: MGST2
  Gene Name: microsomal glutathione S-transferase 2
  Uniprot ID: Q99735
  ENSP ID: ENSP00000482639

SEQ ID NO: 51336 - protein, 166 aa, Homo sapiens
  Payload ID: 10239
  Gene Symbol: MGST3
  Gene Name: microsomal glutathione S-transferase 3
  ENSP ID: ENSP00000356858
MPWRGRRFRLCRRKMAVLSKEYGFVLLTGAASFIMVAHLAINVSKARKKYKVEYPIMYSTDPENGHIFNCIQRAHQNTLEVYPPFLFFLAVGGVYHPRIASGLGLAWIVGRVLYAYGYYTGEPSKRSRGALGSIALLGLVGTTVCSAFQHLGWVKSGLGSGPKCCH

SEQ ID NO: 51337 - protein, 152 aa, Homo sapiens
  Payload ID: 10239
  Gene Symbol: MGST3
  Gene Name: microsomal glutathione S-transferase 3
  Uniprot ID: O14880
  ENSP ID: ENSP00000356859
MAVLSKEYGFVLLTGAASFIMVAHLAINVSKARKKYKVEYPIMYSTDPENGHIFNCIQRAHQNTLEVYPPFLFFLAVGGVYHPRIASGLGLAWIVGRVLYAYGYYTGEPSKRSRGALGSIALLGLVGTTVCSAFQHLGWVKSGLGSGPKCCH

SEQ ID NO: 51338 - protein, 166 aa, Homo sapiens; identical to SEQ ID NO: 51336
  Payload ID: 10239
  Gene Symbol: MGST3
  Gene Name: microsomal glutathione S-transferase 3
  ENSP ID: ENSP00000356860

SEQ ID NO: 51339 - protein, 129 aa, Homo sapiens
  Payload ID: 10239
  Gene Symbol: MGST3
  Gene Name: microsomal glutathione S-transferase 3
  ENSP ID: ENSP00000356863
MAVLSKEYGFVLLTGAASFIMVAHLAINVSKARKKYKVEYPIMYSTDPENGHIFNCIQRAHQNTLEVYPPFLFFLAVGGVYHPRIASGLGLAWIVGRVLYAYGYYTGEVSNRLASLGHTGRRRIVLGHT

SEQ ID NO: 51340 - protein, 152 aa, Homo sapiens; identical to SEQ ID NO: 51337
  Payload ID: 10239
  Gene Symbol: MGST3
  Gene Name: microsomal glutathione S-transferase 3
  Uniprot ID: O14880
  ENSP ID: ENSP00000356864

SEQ ID NO: 51341 - protein, 166 aa, Homo sapiens; identical to SEQ ID NO: 51336
  Payload ID: 10239
  Gene Symbol: MGST3
  Gene Name: microsomal glutathione S-transferase 3
  ENSP ID: ENSP00000487151

SEQ ID NO: 51342 - protein, 894 aa, Homo sapiens
  Payload ID: 10240
  Gene Symbol: MTTP
  Gene Name: microsomal triglyceride transfer protein
  Uniprot ID: P55157
  ENSP ID: ENSP00000265517
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLPFITDEVKKTLNRIYHQNRKVHEKTVRTAAAAIILNNNPSYMDVKNILLSIGELPQEMNKYMLAIVQDILRFEMPASKIVRRVLKEMVAHNYDRFSRSGSSSAYTGYIERSPRSASTYSLDILYSGSGILRRSNLNIFQYIGKAGLHGSQVVIEAQGLEALIAATPDEGEENLDSYAGMSAILFDVQLRPVTFFNGYSDLMSKMLSASGDPISVVKGLILLIDHSQELQLQSGLKANIEVQGGLAIDISGAMEFSLWYRESKTRVKNRVTVVITTDITVDSSFVKAGLETSTETEAGLEFISTVQFSQYPFLVCMQMDKDEAPFRQFEKKYERLSTGRGYVSQKRKESVLAGCEFPLHQENSEMCKVVFAPQPDSTSSGWF

SEQ ID NO: 51343 - protein, 894 aa, Homo sapiens; identical to SEQ ID NO: 51342
  Payload ID: 10240
  Gene Symbol: MTTP
  Gene Name: microsomal triglyceride transfer protein
  Uniprot ID: P55157
  ENSP ID: ENSP00000400821

SEQ ID NO: 51344 - protein, 151 aa, Homo sapiens
  Payload ID: 10240
  Gene Symbol: MTTP
  Gene Name: microsomal triglyceride transfer protein
  Uniprot ID: P55157
  ENSP ID: ENSP00000407350
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKGRLDSTTFSPTSYFSSLQ

SEQ ID NO: 51345 - protein, 72 aa, Homo sapiens
  Payload ID: 10240
  Gene Symbol: MTTP
  Gene Name: microsomal triglyceride transfer protein
  ENSP ID: ENSP00000422178
MEERGGVYAGRGLELVFWEWEVVTVMSVFSRSRIKCVPADVYSFIYSCRPSIITRIHKTEEGDRRDGQSDMK

SEQ ID NO: 51346 - protein, 56 aa, Homo sapiens
  Payload ID: 10240
  Gene Symbol: MTTP
  Gene Name: microsomal triglyceride transfer protein
  ENSP ID: ENSP00000422667
MEERGGVYAGRGLELVFWEWEVVTVMSVFSRSRIKCVPADVYSFIYSCEYWMKELR

SEQ ID NO: 51347 - protein, 50 aa, Homo sapiens
  Payload ID: 10240
  Gene Symbol: MTTP
  Gene Name: microsomal triglyceride transfer protein
  ENSP ID: ENSP00000422782
MEERGGVYAGRGLELVFWEWEVVTVMSVFSRSRIKCVPADVYSFIYSCPV

SEQ ID NO: 51348 - protein, 42 aa, Homo sapiens
  Payload ID: 10240
  Gene Symbol: MTTP
  Gene Name: microsomal triglyceride transfer protein
  ENSP ID: ENSP00000424972
MARAPLRPENTIVRGSANQCQDTYRAEELTGSEEGHSLTGCH

SEQ ID NO: 51349 - protein, 59 aa, Homo sapiens
  Payload ID: 10240
  Gene Symbol: MTTP
  Gene Name: microsomal triglyceride transfer protein
  ENSP ID: ENSP00000425642
MEERGGVYAGRGLELVFWEWEVVTVMSVFSRSRIKCVPADVYSFIYSCSEEGHSLTGCH

SEQ ID NO: 51350 - protein, 55 aa, Homo sapiens
  Payload ID: 10240
  Gene Symbol: MTTP
  Gene Name: microsomal triglyceride transfer protein
  ENSP ID: ENSP00000425987
MARAPLRPENTIVRGSANQCQDTYRAEELTGRPSIITRIHKTEEGDRRDGQSDMK

SEQ ID NO: 51351 - protein, 178 aa, Homo sapiens
  Payload ID: 10240
  Gene Symbol: MTTP
  Gene Name: microsomal triglyceride transfer protein
  ENSP ID: ENSP00000426755
MARAPLRPENTIVRGSANQCQDTYRAEELTGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEV

SEQ ID NO: 51352 - protein, 921 aa, Homo sapiens
  Payload ID: 10240
  Gene Symbol: MTTP
  Gene Name: microsomal triglyceride transfer protein
  ENSP ID: ENSP00000427679
MEERGGVYAGRGLELVFWEWEVVTVMSVFSRSRIKCVPADVYSFIYSCHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLPFITDEVKKTLNRIYHQNRKVHEKTVRTAAAAIILNNNPSYMDVKNILLSIGELPQEMNKYMLAIVQDILRFEMPASKIVRRVLKEMVAHNYDRFSRSGSSSAYTGYIERSPRSASTYSLDILYSGSGILRRSNLNIFQYIGKAGLHGSQVVIEAQGLEALIAATPDEGEENLDSYAGMSAILFDVQLRPVTFFNGYSDLMSKMLSASGDPISVVKGLILLIDHSQELQLQSGLKANIEVQGGLAIDISGAMEFSLWYRESKTRVKNRVTVVITTDITVDSSFVKAGLETSTETEAGLEFISTVQFSQYPFLVCMQMDKDEAPFRQFEKKYERLSTGRGYVSQKRKESVLAGCEFPLHQENSEMCKVVFAPQPDSTSSGWF

SEQ ID NO: 51353 - protein, 516 aa, Homo sapiens
  Payload ID: 10240
  Gene Symbol: MTTP
  Gene Name: microsomal triglyceride transfer protein
  ENSP ID: ENSP00000482850
MILLAVLFLCFISSYSASVKGHTTGLSLNNDRLYKLTYSTEVLLDRGKGKLQDSVGYRISSNVDVALLWRNPDGDDDQLIQITMKDVNVENVNQQRGEKSIFKGKSPSKIMGKENLEALQRPTLLHLIHGKVKEFYSYQNEAVAIENIKRGLASLFQTQLSSGTTNEVDISGNCKVTYQAHQDKVIKIKALDSCKIARSGFTTPNQVLGVSSKATSVTTYKIEDSFVIAVLAEETHNFGLNFLQTIKGKIVSKQKLELKTTEAGPRLMSGKQAAAIIKAVDSKYTAIPIVGQVFQSHCKGCPSLSELWRSTRKYLQPDNLSKAEAVRNFLAFIQHLRTAKKEEILQILKMENKEVLPQLVDAVTSAQTSDSLEAILDFLDFKSDSSIILQERFLYACGFASHPNEELLRALISKFKGSIGSSDIRETVMIITGTLVRKLCQNEGCKLKAVVEAKKLILGGLEKAEKKEDTRMYLLALKNALLPEGIPSLLKYAEAGEGPISHLATTALQRYDLFHN

SEQ ID NO: 51354 - protein, 462 aa, Homo sapiens
  Payload ID: 10241
  Gene Symbol: MCRS1
  Gene Name: microspherule protein 1
  Uniprot ID: Q96EZ8
  ENSP ID: ENSP00000345358
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 51355 - protein, 475 aa, Homo sapiens
  Payload ID: 10241
  Gene Symbol: MCRS1
  Gene Name: microspherule protein 1
  Uniprot ID: Q96EZ8
  ENSP ID: ENSP00000349640
MTRGTGGTAQRGRSGPDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 51356 - protein, 271 aa, Homo sapiens
  Payload ID: 10241
  Gene Symbol: MCRS1
  Gene Name: microspherule protein 1
  Uniprot ID: Q96EZ8
  ENSP ID: ENSP00000444982
MRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVEIASLRFVFLINQDLIALIRAEAAKITPQ

SEQ ID NO: 51357 - protein, 318 aa, Homo sapiens
  Payload ID: 10241
  Gene Symbol: MCRS1
  Gene Name: microspherule protein 1
  ENSP ID: ENSP00000447514
MASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQSKALFSKAEEQLLSKVGSTSQPTLETFQDLLHRHPDAFYLARTAKALQAHWQLMKQYYLLEDQTVQPLPKGDQVLNFSDAEDLIDDSKLKDMRDEVLEHELMVADRRQKREIRQLEQELHKWQVLVD

SEQ ID NO: 51358 - protein, 144 aa, Homo sapiens
  Payload ID: 10241
  Gene Symbol: MCRS1
  Gene Name: microspherule protein 1
  ENSP ID: ENSP00000447592
MDKDSQGLLDSSLMASGTASRSEDEESLAGQKRASSQALGTIPKRRSSSRTLYRFIKRKKFDDELVESSLAKSSTRAKGASGVEPGRCSGSEPSSSEKKKVSKAPSTPVPPSPAPAPGLTKRVKKSKQPLQVTKDLGRWKPADD

SEQ ID NO: 51359 - protein, 61 aa, Homo sapiens
  Payload ID: 10241
  Gene Symbol: MCRS1
  Gene Name: microspherule protein 1
  ENSP ID: ENSP00000447739
MMSWWRAAWQNLLPGQRGPVGWNQGAVRGVNPPPVRRRRYPKPPALLCHPAQPQPLDSPSV

SEQ ID NO: 51360 - protein, 462 aa, Homo sapiens; identical to SEQ ID NO: 51354
  Payload ID: 10241
  Gene Symbol: MCRS1
  Gene Name: microspherule protein 1
  Uniprot ID: Q96EZ8
  ENSP ID: ENSP00000448056

SEQ ID NO: 51361 - protein, 64 aa, Homo sapiens
  Payload ID: 10241
  Gene Symbol: MCRS1
  Gene Name: microspherule protein 1
  ENSP ID: ENSP00000448700
QLEQELHKWQVLVDSITGMSSPDFDNQTLAVLRGRMVRYLMRSREVPALTCPISPDHPGQSNQG

SEQ ID NO: 51362 - protein, 173 aa, Homo sapiens
  Payload ID: 10241
  Gene Symbol: MCRS1
  Gene Name: microspherule protein 1
  ENSP ID: ENSP00000448947
KLKDMRDEVLEHELMVADRRQKREIRQLEQELHKWQVLVDSITGMSSPDFDNQTLAVLRGRMVRYLMRSREITLGRATKDNQIDVDLSLEGPAWKISRKQGVIKLKNNGDFFIANEGRRPIYIDGRPVLCGSKWRLSNNSVVETGSWGQRSQIHTARKLTEQGYKPSSWLRRN

SEQ ID NO: 51363 - protein, 185 aa, Homo sapiens
  Payload ID: 10241
  Gene Symbol: MCRS1
  Gene Name: microspherule protein 1
  ENSP ID: ENSP00000449343
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVIS

SEQ ID NO: 51364 - protein, 205 aa, Homo sapiens
  Payload ID: 10241
  Gene Symbol: MCRS1
  Gene Name: microspherule protein 1
  ENSP ID: ENSP00000450352
MDKDSQGLLDSSLMASGTASRSEDEESLAGQKRASSQALGTIPKRRSSSRFIKRKKFDDELVESSLAKSSTRAKGASGVEPGRCSGSEPSSSEKKKVSKAPSTPVPPSPAPAPGLTKRVKKSKQPLQVTKDLGRWKPADDLLLINAVLQTNDLTSVHLGVKFSCRFTLREVQERWYALLYDPVISKLACQAMRQLHPEAIAAIQS

SEQ ID NO: 51365 - protein, 981 aa, Homo sapiens
  Payload ID: 10242
  Gene Symbol: MICAL1
  Gene Name: microtubule associated monooxygenase, calponin and LIM domain containing 1
  Uniprot ID: Q8TDZ2
  ENSP ID: ENSP00000351385
MASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKAEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 51366 - protein, 1067 aa, Homo sapiens [sequence omitted]

SEQ ID NO: 51367 - protein, 244 aa, Homo sapiens
  Payload ID: 10242
  Gene Symbol: MICAL1
  Gene Name: microtubule associated monooxygenase, calponin and LIM domain containing 1
  ENSP ID: ENSP00000407075
MASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANF

SEQ ID NO: 51368 - protein, 252 aa, Homo sapiens
  Payload ID: 10242
  Gene Symbol: MICAL1
  Gene Name: microtubule associated monooxygenase, calponin and LIM domain containing 1
  ENSP ID: ENSP00000408924
  MOD_RES (1)..(1): Any amino acid
XESLYQLLSQTSPENMHRNVAQYGLDPATRYPNLNLRAVTPNQVRDLYDVLAKEPVQRNNDKTDTGMPATGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQE

SEQ ID NO: 51369 - protein, 1086 aa, Homo sapiens
  Payload ID: 10242
  Gene Symbol: MICAL1
  Gene Name: microtubule associated monooxygenase, calponin and LIM domain containing 1
  Uniprot ID: Q8TDZ2
  ENSP ID: ENSP00000486901
MSCLSHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKAEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 51370 - protein, 1124 aa, Homo sapiens
  Payload ID: 10243
  Gene Symbol: MICAL2
  Gene Name: microtubule associated monooxygenase, calponin and LIM domain containing 2
  Uniprot ID: O94851
  ENSP ID: ENSP00000256194
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKEKKSPSGFHFHPSHLRTVHPQLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 51371 - protein, 1103 aa, Homo sapiens
  Payload ID: 10243
  Gene Symbol: MICAL2
  Gene Name: microtubule associated monooxygenase, calponin and LIM domain containing 2
  Uniprot ID: O94851
  ENSP ID: ENSP00000344894
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 51372 - protein, 976 aa, Homo sapiens
  Payload ID: 10243
  Gene Symbol: MICAL2
  Gene Name: microtubule associated monooxygenase, calponin and LIM domain containing 2
  Uniprot ID: O94851
  ENSP ID: ENSP00000368932
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQEKKSPSGFHFHPSHLRTVHPQESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGISTSFFRKVLGWPLRLPRDLCNWMQGLLQAAGLHIRDNAYNYCYMYELLSLGLPLLWAFSEVLAAMYRESEGSLESICNWVLRCFPVKLR

SEQ ID NO: 51373 - protein, 101 aa, Homo sapiens
  Payload ID: 10243
  Gene Symbol: MICAL2
  Gene Name: microtubule associated monooxygenase, calponin and LIM domain containing 2
  ENSP ID: ENSP00000433357
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRT

SEQ ID NO: 51374 - protein, 134 aa, Homo sapiens
  Payload ID: 10243
  Gene Symbol: MICAL2
  Gene Name: microtubule associated monooxygenase, calponin and LIM domain containing 2
  ENSP ID: ENSP00000433509
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTI

SEQ ID NO: 51375 - protein, 88 aa, Homo sapiens
  Payload ID: 10243
  Gene Symbol: MICAL2
  Gene Name: microtubule associated monooxygenase, calponin and LIM domain containing 2
  ENSP ID: ENSP00000433818
MGENEDEKQAQAGQVFENFVQASTCKGTLQAFNILTRHLDLDPLDHRNFYSKLKSKVTTWKAKALWYKLDKRGSHKEYKRGKSCTNTK

SEQ ID NO: 51376 - protein, 934 aa, Homo sapiens
  Payload ID: 10243
  Gene Symbol: MICAL2
  Gene Name: microtubule associated monooxygenase, calponin and LIM domain containing 2
  Uniprot ID: O94851
  ENSP ID: ENSP00000433965
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQEKKSPSGFHFHPSHLRTVHPQLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 51377 - protein, 98 aa, Homo sapiens
  Payload ID: 10243
  Gene Symbol: MICAL2
  Gene Name: microtubule associated monooxygenase, calponin and LIM domain containing 2
  ENSP ID: ENSP00000434209
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCG

SEQ ID NO: 51378 - protein, 3 aa, Homo sapiens
  Payload ID: 10243
  Gene Symbol: MICAL2
  Gene Name: microtubule associated monooxygenase, calponin and LIM domain containing 2
  ENSP ID: ENSP00000434957
MGE

SEQ ID NO: 51379 - protein, 88 aa, Homo sapiens; identical to SEQ ID NO: 51375
  Payload ID: 10243
  Gene Symbol: MICAL2
  Gene Name: microtubule associated monooxygenase, calponin and LIM domain containing 2
  ENSP ID: ENSP00000435270

SEQ ID NO: 51380 - protein, 120 aa, Homo sapiens
  Payload ID: 10243
  Gene Symbol: MICAL2
  Gene Name: microtubule associated monooxygenase, calponin and LIM domain containing 2
  ENSP ID: ENSP00000437229
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDS

SEQ ID NO: 51381 - protein, 1124 aa, Homo sapiens; identical to SEQ ID NO: 51370
  Payload ID: 10243
  Gene Symbol: MICAL2
  Gene Name: microtubule associated monooxygenase, calponin and LIM domain containing 2
  Uniprot ID: O94851
  ENSP ID: ENSP00000441689

SEQ ID NO: 51382 - protein, 948 aa, Homo sapiens
  Payload ID: 10244
  Gene Symbol: MICAL3
  Gene Name: microtubule associated monooxygenase, calponin and LIM domain containing 3
  Uniprot ID: Q7RTP6
  ENSP ID: ENSP00000372574
MEERKHETMNPAHVLFDRFVQATTCKGTLKAFQELCDHLELKPKDYRSFYHKLKSKLNYWKAKALWAKLDKRGSHKDYKKGKACTNTKCLIIGAGPCGLRTAIDLSLLGAKVVVIEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASRSARRAAGRPPATRP

SEQ ID NO: 51383 - protein, 966 aa, Homo sapiens
  Payload ID: 10244
  Gene Symbol: MICAL3
  Gene Name: microtubule associated monooxygenase, calponin and LIM domain containing 3
  Uniprot ID: Q7RTP6
  ENSP ID: ENSP00000383406
MEERKHETMNPAHVLFDRFVQATTCKGTLKAFQELCDHLELKPKDYRSFYHKLKSKLNYWKAKALWAKLDKRGSHKDYKKGKACTNTKCLIIGAGPCGLRTAIDLSLLGAKVVVIEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASRDWVSPWLPRMVSNSWAQMIHPPQPPTVLGSQM

SEQ ID NO: 51384 - protein, 976 aa, Homo sapiens
  Payload ID: 10244
  Gene Symbol: MICAL3
  Gene Name: microtubule associated monooxygenase, calponin and LIM domain containing 3
  Uniprot ID: Q7RTP6
  ENSP ID: ENSP00000391827
MEERKHETMNPAHVLFDRFVQATTCKGTLKAFQELCDHLELKPKDYRSFYHKLKSKLNYWKAKALWAKLDKRGSHKDYKKGKACTNTKCLIIGAGPCGLRTAIDLSLLGAKVVVIEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQLTQERGASQPSCCLPGQVRPAPTPRWKQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASRSARRAAGRPPATRP

SEQ ID NO: 51385 - protein, 125 aa, Homo sapiens
  Payload ID: 10244
  Gene Symbol: MICAL3
  Gene Name: microtubule associated monooxygenase, calponin and LIM domain containing 3
  ENSP ID: ENSP00000406193
MEERKHETMNPAHVLFDRFVQATTCKGTLKAFQELCDHLELKPKDYRSFYHKLKSKLNYWKAKALWAKLDKRGSHKDYKKGKACTNTKCLIIGAGPCGLRTAIDLSLLGAKVVVIEKRDAFSRNN

SEQ ID NO: 51386 - protein, 2002 aa, Homo sapiens
  Payload ID: 10244
  Gene Symbol: MICAL3
  Gene Name: microtubule associated monooxygenase, calponin and LIM domain containing 3
  Uniprot ID: Q7RTP6
  ENSP ID: ENSP00000416015
MEERKHETMNPAHVLFDRFVQATTCKGTLKAFQELCDHLELKPKDYRSFYHKLKSKLNYWKAKALWAKLDKRGSHKDYKKGKACTNTKCLIIGAGPCGLRTAIDLSLLGAKVVVIEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASSSSESEMEEEGEEEEEEPRLPPSDLGGVPWKEAVRIHALLKGKSEEELEASKSFGPGNEEEEEEEEEYEEEEEEDYDEEEEESSEAGNQRLQQVMHAADPLEIQADVHWTHIREREEEERMAPASESSASGAPLDENDLEEDVDSEPAEIEGEAAEDGDPGDTGAELDDDQHWSDSPSDADRELRLPCPAEGEAELELRVSEDEEKLPASPKHQERGPSQATSPIRSPQESALLFIPVHSPSTEGPQLPPVPAATQEKSPEERLFPEPLLPKEKPKADAPSDLKAVHSPIRSQPVTLPEARTPVSPGSPQPQPPVAASTPPPSPLPICSQPQPSTEATVPSPTQSPIRFQPAPAKTSTPLAPLPVQSQSDTKDRLGSPLAVDEALRRSDLVEEFWMKSAEIRRSLGLTPVDRSKGPEPSFPTPAFRPVSLKSYSVEKSPQDEGLHLLKPLSIPKRLGLPKPEGEPLSLPTPRSPSDRELRSAQEERRELSSSSGLGLHGSSSNMKTLGSQSFNTSDSAMLTPPSSPPPPPPPGEEPATLRRKLREAEPNASVVPPPLPATWMRPPREPAQPPREEVRKSFVESVEEIPFADDVEDTYDDKTEDSSLQEKFFTPPSCWPRPEKPRHPPLAKENGRLPALEGTLQPQKRGLPLVSAEAKELAEERMRAREKSVKSQALRDAMARQLSRMQQMELASGAPRPRKASSAPSQGKERRPDSPTRPTLRGSEEPTLKHEATSEEVLSPPSDSGGPDGSFTSSEGSSGKSKKRSSLFSPRRNKKEKKSKGEGRPPEKPSSNLLEEAAAKPKSLWKSVFSGYKKDKKKKADDKSCPSTPSSGATVDSGKHRVLPVVRAELQLRRQLSFSEDSDLSSDDVLEKSSQKSRREPRTYTEEELNAKLTRRVQKAARRQAKQEELKRLHRAQIIQRQLQQVEERQRRLEERGVAVEKALRGEAGMGKKDDPKLMQEWFKLVQEKNAMVRYESELMIFARELELEDRQSRLQQELRERMAVEDHLKTEEELSEEKQILNEMLEVVEQRDSLVALLEEQRLREREEDKDLEAAMLSKGFSLNWS

SEQ ID NO: 51387 - protein, 335 aa, Homo sapiens
  Payload ID: 10244
  Gene Symbol: MICAL3
  Gene Name: microtubule associated monooxygenase, calponin and LIM domain containing 3
  ENSP ID: ENSP00000434678
MEERKHETMNPAHVLFDRFVQATTCKGTLKAFQELCDHLELKPKDYRSFYHKLKSKLNYWKAKALWAKLDKRGSHKDYKKGKACTNTKCLIIGAGPCGLRTAIDLSLLGAKVVVIEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATGLRRHRAPAFPRKRGPGGSAQLCQGGGRLLYPAAAAVSGFCHQSLWAARCGHV

SEQ ID NO: 51388 - protein, 1073 aa, Homo sapiens
  Payload ID: 10244
  Gene Symbol: MICAL3
  Gene Name: microtubule associated monooxygenase, calponin and LIM domain containing 3
  Uniprot ID: Q7RTP6
  ENSP ID: ENSP00000462033
MEERKHETMNPAHVLFDRFVQATTCKGTLKAFQELCDHLELKPKDYRSFYHKLKSKLNYWKAKALWAKLDKRGSHKDYKKGKACTNTKCLIIGAGPCGLRTAIDLSLLGAKVVVIEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQQREKECSRTCPKKVITLSPPPTPPPCRAHGGQQTYRDLDADNRGKQSPHHERPEPEPPRRFFVDQWELSLSLRSSARPASPSSDSLRQKYIKMYTGGVSSLAEQIANQLQRKEQPKALLDKKELGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSLTSLFGWVARHSLGLCDKAKGMSQHLQSNISSFGQQVAQNPLDSFFMCQLLAFGVPFLYGLSEVLVQIRGEFHWQAVAQ

SEQ ID NO: 51389 - protein, 173 aa, Homo sapiens
  Payload ID: 10244
  Gene Symbol: MICAL3
  Gene Name: microtubule associated monooxygenase, calponin and LIM domain containing 3
  ENSP ID: ENSP00000462107
GYKKDKKKKADDKSCPSTPSSGATVDSGKHRVLPVVRAELQLRRQLSFSEDSDLSSDDVLEKSSQKSRREPRTYTEEELNAKLTRRVQKAARRQAKQEELKRLHRAQIIQRQLQQVEERQRRLEERGVAVEKALRGEAVEPSGGTPRRRPLSFCPCCVQEGMGKKDDPKLMQE

SEQ ID NO: 51390 - protein, 496 aa, Homo sapiens
  Payload ID: 10244
  Gene Symbol: MICAL3
  Gene Name: microtubule associated monooxygenase, calponin and LIM domain containing 3
  ENSP ID: ENSP00000462531
  MOD_RES (1)..(1): Any amino acid
XQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQLTQERGASQPSCCLPGQVRPAPTPRWKQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSLTSLFGWVARHSLGLCDKAKGMSQHLQSNISSFGQQVAQNPLDSFFMCQLLAFGVPFLYGLSEVLVQIRGEFHWQAVAQ

SEQ ID NO: 51391 - protein, 139 aa, Homo sapiens
  Payload ID: 10244
  Gene Symbol: MICAL3
  Gene Name: microtubule associated monooxygenase, calponin and LIM domain containing 3
  ENSP ID: ENSP00000462905
  MOD_RES (1)..(1): Any amino acid
XQEELKRLHRAQIIQRQLQQVEERQRRLEERGVAVEKALRGEADYWGESYYSDLIDLHLGGMYGSACADTNPADALSPPTLPSPCSQKQGEINPITKWQKHRPFSSSKQSSVLISPLPTCAPEEDLSLLLLPGVVFNFL

SEQ ID NO: 51392 - protein, 190 aa, Homo sapiens
  Payload ID: 10244
  Gene Symbol: MICAL3
  Gene Name: microtubule associated monooxygenase, calponin and LIM domain containing 3
  ENSP ID: ENSP00000463453
  MOD_RES (1)..(1): Any amino acid
XEEEEEEYEEEEEEDYDEEEEESSEVPDLPSIRHAAVQAWLETVSGAPLDENDLEEDVDSEPAEIEGEAAEDGDPGDTGAELDDDQHWSDSPSDADRELRLPCPAEGEAELELRVSEDEEKLPASPKHQERGPSQATSPIRSPQESALLFIPVHSPSTEGPQLPPVPAATQEKSPEERLFPEPLLPKEKP

SEQ ID NO: 51393 - protein, 269 aa, Homo sapiens
  Payload ID: 10244
  Gene Symbol: MICAL3
  Gene Name: microtubule associated monooxygenase, calponin and LIM domain containing 3
  ENSP ID: ENSP00000463882
  MOD_RES (1)..(1): Any amino acid
XSSNLLEEAAAKPKSLWKSVFSGYKKDKKKKADDKSCPSTPSSGATVDSGKHRVLPVVRAELQLRRQLSFSEDSDLSSDDVLEKSSQKSRRESIYVPHALAFRRSCASKPRTYTEEELNAKLTRRVQKAARRQAKQEELKRLHRAQIIQRQLQQVEERQRRLEERGVAVEKALRGEADYWGESYYSDLIDLHLGGMGKKDDPKLMQEWFKLVQEKNAMVRYESELMIFARELELEDRQSRLQQELRERMAVEGEWGKAPMEARVGATSR

SEQ ID NO: 51394 - protein, 198 aa, Homo sapiens
  Payload ID: 10244
  Gene Symbol: MICAL3
  Gene Name: microtubule associated monooxygenase, calponin and LIM domain containing 3
  ENSP ID: ENSP00000464007
  MOD_RES (1)..(1): Any amino acid
XALLKGKSEEELEASKSFGPGNEEEEEEEEEYEEEEEEDYDEEEEESSEAPLDENDLEEDVDSEPAEIEGEAAEDGDPGDTGAELDDDQHWSDSPSDADRELRLPCPAEGEAELELRVSEDEEKLPASPKHQERGPSQATSPIRSPQESALLFIPVHSPSTEGPQLPPVPAATQEKSPEERLFPEPLLPKEKPKADAP

SEQ ID NO: 51395 - protein, 1570 aa, Homo sapiens
  Payload ID: 10245
  Gene Symbol: MAST1
  Gene Name: microtubule associated serine/threonine kinase 1
  Uniprot ID: Q9Y2H9
  ENSP ID: ENSP00000251472
MSDSLWTALSNFSMPSFPGGSMFRRTKSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGGDCATLLKNIGALPVEMARMYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDDILWPEGDEALPTEAQLLISSLLQTNPLVRLGAGGAFEVKQHSFFRDLDWTGLLRQKAEFIPHLESEDDTSYFDTRSDRYHHVNSYDEDDTTEEEPVEIRQFSSCSPRFSKVYSSMEQLSQHEPKTPVAAAGSSKREPSTKGPEEKVAGKREGLGGLTLREKTWRGGSPEIKRFSASEASFLEGEASPPLGARRRFSALLEPSRFSAPQEDEDEARLRRPPRPSSDPAGSLDARAPKEETQGEGTSSAGDSEATDRPRPGDLCPPSKDGDASGPRATNDLVLRRARHQQMSGDVAVEKRPSRTGGKVIKSASATALSVMIPAVDPHGSSPLASPMSPRSLSSNPSSRDSSPSRDYSPAVSGLRSPITIQRSGKKYGFTLRAIRVYMGDTDVYSVHHIVWHVEEGGPAQEAGLCAGDLITHVNGEPVHGMVHPEVVELILKSGNKVAVTTTPFENTSIRIGPARRSSYKAKMARRNKRPSAKEGQESKKRSSLFRKITKQSNLLHTSRSLSSLNRSLSSSDSLPGSPTHGLPARSPTHSYRSTPDSAYLGASSQSSSPASSTPNSPASSASHHIRPSTLHGLSPKLHRQYRSARCKSAGNIPLSPLAHTPSPTQASPPPLPGHTVGSSHTTQSFPAKLHSSPPVVRPRPKSAEPPRSPLLKRVQSAEKLGASLSADKKGALRKHSLEVGHPDFRKDFHGELALHSLAESDGETPPVEGLGAPRQVAVRRLGRQESPLSLGADPLLPEGASRPPVSSKEKESPGGAEACTPPRATTPGGRTLERDVGCTRHQSVQTEDGTGGMARAVAKAALSPVQEHETGRRSSSGEAGTPLVPIVVEPARPGAKAVVPQPLGADSKGLQEPAPLAPSVPEAPRGRERWVLEVVEERTTLSGPRSKPASPKLSPEPQTPSLAPAKCSAPSSAVTPVPPASLLGSGTKPQVGLTSRCPAEAVPPAGLTKKGVSSPAPPGP

SEQ ID NO: 51396 - protein, 133 aa, Homo sapiens
  Payload ID: 10245
  Gene Symbol: MAST1
  Gene Name: microtubule associated serine/threonine kinase 1
  ENSP ID: ENSP00000465187
  MOD_RES (1)..(1): Any amino acid
XRAPPPSLPQATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAK

SEQ ID NO: 51397 - protein, 433 aa, Homo sapiens
  Payload ID: 10245
  Gene Symbol: MAST1
  Gene Name: microtubule associated serine/threonine kinase 1
  ENSP ID: ENSP00000465395
  MOD_RES (1)..(1): Any amino acid
XRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGVAACGAAGKMGPCSLVRAAGWPA

SEQ ID NO: 51398 - protein, 475 aa, Homo sapiens
  Payload ID: 10245
  Gene Symbol: MAST1
  Gene Name: microtubule associated serine/threonine kinase 1
  ENSP ID: ENSP00000466470
MDDSGLIRRRRLQKDLPLPRKSSSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGVAACGAAGKMGPCSLVRAAGWPA

SEQ ID NO: 51399 - protein, 1798 aa, Homo sapiens
  Payload ID: 10246
  Gene Symbol: MAST2
  Gene Name: microtubule associated serine/threonine kinase 2
  Uniprot ID: Q6P0Q8
  ENSP ID: ENSP00000354671
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQDNLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKIGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPSRDFLPALGSMRPPIIIHRAGKKYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSVGGNSSQSSSPSSSVPSSPAGSGHTRPSSLHGLAPKLQRQYRSPRRKSAGSIPLSPLAHTPSPPPPTASPQRSPSPLSGHVAQAFPTKLHLSPPLGRQLSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 51400 - protein, 787 aa, Homo sapiens
  Payload ID: 10246
  Gene Symbol: MAST2
  Gene Name: microtubule associated serine/threonine kinase 2
  ENSP ID: ENSP00000361078
MFSPTSAPALFLTKVPFSADCALATSPLAIFLNPRAHSSPGTPCSSRPLPWSCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQDNLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKIGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPE

SEQ ID NO: 51401 - protein, 791 aa, Homo sapiens
  Payload ID: 10246
  Gene Symbol: MAST2
  Gene Name: microtubule associated serine/threonine kinase 2
  ENSP ID: ENSP00000361079
MRPRSRSLSPGRSPVSFDSEIIMMNHVYKERFPKAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKIGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPRSMASPCGPFASTWVTPMSTPCTIWCGTWRMEVRPVRQGFVKVTSSPMSMGNLCMAWCTRRWS

SEQ ID NO: 51402 - protein, 1309 aa, Homo sapiens
  Payload ID: 10247
  Gene Symbol: MAST3
  Gene Name: microtubule associated serine/threonine kinase 3
  Uniprot ID: O60307
  ENSP ID: ENSP00000262811
MDESSLLRRRGLQKELSLPRRGRGCRSGNRKSLVVGTPSPTLSRPLSPLSVPTAGSSPLDSPRNFSAASALNFPFARRADGRRWSLASLPSSGYGTNTPSSTLSSSSSSRERLHQLPFQPTPDELHFLSKHFRSSENVLDEEGGRSPRLRPRSRSLSPGRATGTFDNEIVMMNHVYRERFPKATAQMEGRLQEFLTAYAPGARLALADGVLGFIHHQIVELARDCLAKSGENLVTSRYFLEMQEKLERLLQDAHERSDSEEVSFIVQLVRKLLIIISRPARLLECLEFDPEEFYHLLEAAEGHAREGQGIKTDLPQYIIGQLGLAKDPLEEMVPLSHLEEEQPPAPESPESRALVGQSRRKPCESDFETIKLISNGAYGAVYLVRHRDTRQRFAIKKINKQNLILRNQIQQVFVERDILTFAENPFVVSMFCSFETRRHLCMVMEYVEGGDCATLLKNMGPLPVDMARLYFAETVLALEYLHNYGIVHRDLKPDNLLITSLGHIKLTDFGLSKIGLMSMATNLYEGHIEKDAREFIDKQVCGTPEYIAPEVIFRQGYGKPVDWWAMGVVLYEFLVGCVPFFGDTPEELFGQVVSDEIMWPEGDEALPADAQDLITRLLRQSPLDRLGTGGTHEVKQHPFFLALDWAGLLRHKAEFVPQLEAEDDTSYFDTRSERYRHLGSEDDETNDEESSTEIPQFSSCSHRFSKVYSSSEFLAVQPTPTFAERSFSEDREEGWERSEVDYGRRLSADIRLRSWTSSGSSCQSSSSQPERGPSPSLLNTISLDTMPKFAFSSEDEGVGPGPAGPKRPVFILGEPDPPPAATPVMPKPSSLSADTAALSHARLRSNSIGARHSTPRPLDAGRGRRLGGPRDPAPEKSRASSSGGSGGGSGGRVPKSASVSALSLIITADDGSGGPLMSPLSPRSLSSNPSSRDSSPSRDPSPVCGSLRPPIVIHSSGKKYGFSLRAIRVYMGDSDVYTVHHVVWSVEDGSPAQEAGLRAGDLITHINGESVLGLVHMDVVELLLKSGNKISLRTTALENTSIKVGPARKNVAKGRMARRSKRSRRRETQDRRKSLFKKISKQTSVLHTSRSFSSGLHHSLSSSESLPGSPTHSLSPSPTTPCRSPAPDVPADTTASPPSASPSSSSPASPAAAGHTRPSSLHGLAAKLGPPRPKTGRRKSTSSIPPSPLACPPISAPPPRSPSPLPGHPPAPARSPRLRRGQSADKLGTGERLDGEAGRRTRGPEAELVVMRRLHLSERRDSFKKQEAVQEVSFDEPQEEATGLPTSVPQIAVEGEEAVPVALGPTGRD

SEQ ID NO: 51403 - protein, 86 aa, Homo sapiens
  Payload ID: 10247
  Gene Symbol: MAST3
  Gene Name: microtubule associated serine/threonine kinase 3
  ENSP ID: ENSP00000477109
FDTRSERYRHLGSEDDETNDEESSTEIPQFSSCSHRFSKVYSSSEFLAVQPTPTFAERSFSEDREEGWERSEVDYGRRLSADIRGA

SEQ ID NO: 51404 - protein, 2429 aa, Homo sapiens
  Payload ID: 10248
  Gene Symbol: MAST4
  Gene Name: microtubule associated serine/threonine kinase family member 4
  Uniprot ID: O15021
  ENSP ID: ENSP00000261569
MDMSDPNFWTVLSNFTLPHLRSGNRLRRTQSCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGRVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 51405 - protein, 2444 aa, Homo sapiens
  Payload ID: 10248
  Gene Symbol: MAST4
  Gene Name: microtubule associated serine/threonine kinase family member 4
  ENSP ID: ENSP00000384099
MKAQRERLQIPGLTLDLTPRSLSPTPSSPGSPCSPLLAFHFWSCRTSNRKSLIGNGQSPALPRPHSPLSAHAGNSPQDSPRNFSPSASAHFSFARRNDRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGRVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 51406 - protein, 2434 aa, Homo sapiens
  Payload ID: 10248
  Gene Symbol: MAST4
  Gene Name: microtubule associated serine/threonine kinase family member 4
  Uniprot ID: O15021
  ENSP ID: ENSP00000384313
MDESSILRRRGLQKELSLPRRGSLIDSQKWNCLVKRCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGRVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 51407 - protein, 238 aa, Homo sapiens
  Payload ID: 10248
  Gene Symbol: MAST4
  Gene Name: microtubule associated serine/threonine kinase family member 4
  ENSP ID: ENSP00000384547
MGEKVSEAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLKELSLPRRGSFPVCPNAGRTSPLG

SEQ ID NO: 51408 - protein, 250 aa, Homo sapiens
  Payload ID: 10248
  Gene Symbol: MAST4
  Gene Name: microtubule associated serine/threonine kinase family member 4
  Uniprot ID: O15021
  ENSP ID: ENSP00000385088
MGEKVSEAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLKELSLPRRGSLIDSQKWNCLVKRPVCPNAGRTSPLG

SEQ ID NO: 51409 - protein, 56 aa, Homo sapiens
  Payload ID: 10248
  Gene Symbol: MAST4
  Gene Name: microtubule associated serine/threonine kinase family member 4
  ENSP ID: ENSP00000385260
MKAQRERLQIPGLTLDLTPRSLSPTPSSPGSPCSPLLAFHFWSPVCPNAGRTSPLG

SEQ ID NO: 51410 - protein, 2623 aa, Homo sapiens
  Payload ID: 10248
  Gene Symbol: MAST4
  Gene Name: microtubule associated serine/threonine kinase family member 4
  ENSP ID: ENSP00000385727
MGEKVSEAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLKELSLPRRGSFCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGRVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 51411 - protein, 167 aa, Homo sapiens
  Payload ID: 10248
  Gene Symbol: MAST4
  Gene Name: microtubule associated serine/threonine kinase family member 4
  ENSP ID: ENSP00000392478
MDMSDPNFWTVLSNFTLPHLRSGNRLRRTQSCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRS

SEQ ID NO: 51412 - protein, 80 aa, Homo sapiens
  Payload ID: 10248
  Gene Symbol: MAST4
  Gene Name: microtubule associated serine/threonine kinase family member 4
  ENSP ID: ENSP00000396765
NLVRMRSQALGQSAPSLTASLKELSLPRRGSLIDSQKWNCLVKRSLSPTPSSPGSPCSPLLAFHFWSPVCPNAGRTSPLG

SEQ ID NO: 51413 - protein, 66 aa, Homo sapiens
  Payload ID: 10248
  Gene Symbol: MAST4
  Gene Name: microtubule associated serine/threonine kinase family member 4
  ENSP ID: ENSP00000398417
  MOD_RES (1)..(1): Any amino acid
XTASLEGQPPKSHFNSARHRQRLVDPAASKKELSLPRRGSLCRSSDCDWVIDKRSERNCFLGKMLL

SEQ ID NO: 51414 - protein, 166 aa, Homo sapiens
  Payload ID: 10248
  Gene Symbol: MAST4
  Gene Name: microtubule associated serine/threonine kinase family member 4
  ENSP ID: ENSP00000398694
MDMSDPNFWTVLSNFTLPHLRSGNRLRRTQSCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSLKG

SEQ ID NO: 51415 - protein, 1680 aa, Homo sapiens
  Payload ID: 10248
  Gene Symbol: MAST4
  Gene Name: microtubule associated serine/threonine kinase family member 4
  ENSP ID: ENSP00000400551
  MOD_RES (1)..(1): Any amino acid
XYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGRVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 51416 - protein, 58 aa, Homo sapiens
  Payload ID: 10248
  Gene Symbol: MAST4
  Gene Name: microtubule associated serine/threonine kinase family member 4
  ENSP ID: ENSP00000404801
LRRRGLQKELSLPRRGSLIDSQKWNCLVKRLTPRSLSPTPSSPGSPCSPLLAFHFWRE

SEQ ID NO: 51417 - protein, 99 aa, Homo sapiens
  Payload ID: 10248
  Gene Symbol: MAST4
  Gene Name: microtubule associated serine/threonine kinase family member 4
  ENSP ID: ENSP00000407977
  MOD_RES (1)..(1): Any amino acid
XPPMPFRKCSNPDVASGPGKSLKYKRQLSEDGRQLRRGSLGGALTGRYLLPNPVAGQAWPASAETSNLVRMRSQALGQSAPSLTASLKELSLPRRGSFN

SEQ ID NO: 51418 - protein, 122 aa, Homo sapiens
  Payload ID: 10248
  Gene Symbol: MAST4
  Gene Name: microtubule associated serine/threonine kinase family member 4
  ENSP ID: ENSP00000413573
PPMPFRKCSNPDVASGPGKSLKYKRQLSEDGRQLRRGSLGGALTGRYLLPNPVAGQAWPASAETSNLVRMRSQALGQSAPSLTASLKELSLPRRGSLCRSSDCDWVIDKRSERNCFLGKMLL

SEQ ID NO: 51419 - protein, 59 aa, Homo sapiens
  Payload ID: 10248
  Gene Symbol: MAST4
  Gene Name: microtubule associated serine/threonine kinase family member 4
  ENSP ID: ENSP00000413854
MKAQRERLQIPGLTLDCRTSNRKSLIGNGQSPALPRPHSPLSAHAGNSPQDSPRNFSPS

SEQ ID NO: 51420 - protein, 350 aa, Homo sapiens
  Payload ID: 10248
  Gene Symbol: MAST4
  Gene Name: microtubule associated serine/threonine kinase family member 4
  ENSP ID: ENSP00000421739
MDESSILRRRGLQKELSLPRRGSLIDSQKWNCLVKRCRTSNRKSLIGNGQSPALPRPHSPLSAHAGNSPQDSPRNFSPSASAHFSFARRTDGRRWSLASLPSSGYGTNTPSSTVSSSCSSQEKLHQLPYQPTPDELHFLSKHFCTTESIATENRCRNTPMRPRSRSLSPGRSPACCDHEIIMMNHVYKERFPKATAQMEERLKEIITSYSPDNVLPLADGVLSFTHHQIIELARDCLDKSHQGLITSRYFLELQHKLDKLLQEAHDRSESGELAFIKQLVRKILIVIARPARLLECLEFDPEEFYYLLEAAEGHAKEGQGIKTDIPRYIISQLGLNKDPLEGESLGCSYL

SEQ ID NO: 51421 - protein, 840 aa, Homo sapiens
  Payload ID: 10249
  Gene Symbol: MASTL
  Gene Name: microtubule associated serine/threonine kinase-like
  Uniprot ID: Q96GX5
  ENSP ID: ENSP00000343446
MDPTAGSKKEPGGGAATEEGVNRIAVPKPPSIEEFSIVKPISRGAFGKVYLGQKGGKLYAVKVVKKADMINKNMTHQVQAERDALALSKSPFIVHLYYSLQSANNVYLVMEYLIGGDVKSLLHIYGYFDEEMAVKYISEVALALDYLHRHGIIHRDLKPDNMLISNEGHIKLTDFGLSKVTLNRDINMMDILTTPSMAKPRQDYSRTPGQVLSLISSLGFNTPIAEKNQDPANILSACLSETSQLSQGLVCPMSVDQKDTTPYSSKLLKSCLETVASNPGMPVKCLTSNLLQSRKRLATSSASSQSHTFISSVESECHSSPKWEKDCQESDEALGPTMMSWNAVEKLCAKSANAIETKGFNKKDLELALSPIHNSSALPTTGRSCVNLAKKCFSGEVSWEAVELDVNNINMDTDTSQLGFHQSNQWAVDSGGISEEHLGKRSLKRNFELVDSSPCKKIIQNKKTCVEYKHNEMTNCYTNQNTGLTVEVQDLKLSVHKSQQNDCANKENIVNSFTDKQQTPEKLPIPMIAKNLMCELDEDCEKNSKRDYLSSSFLCSDDDRASKNISMNSDSSFPGISIMESPLESQPLDSDRSIKESSFEESNIEDPLIVTPDCQEKTSPKGVENPAVQESNQKMLGPPLEVLKTLASKRNAVAFRSFNSHINASNNSEPSRMNMTSLDAMDISCAYSGSYPMAITPTQKRRSCMPHQTPNQIKSGTPYRTPKSVRRGVAPVDDGRILGTPDYLAPELLLGRAHDIPWPEGEEKLSDNAQSAVEILLTIDDTKRAGMKELKRHPLFSDVDWENLQHQTMPFIPQPDDETDTSYFEARNTAQHLTVSGFSL

SEQ ID NO: 51422 - protein, 879 aa, Homo sapiens
  Payload ID: 10249
  Gene Symbol: MASTL
  Gene Name: microtubule associated serine/threonine kinase-like
  Uniprot ID: Q96GX5
  ENSP ID: ENSP00000365107
MDPTAGSKKEPGGGAATEEGVNRIAVPKPPSIEEFSIVKPISRGAFGKVYLGQKGGKLYAVKVVKKADMINKNMTHQVQAERDALALSKSPFIVHLYYSLQSANNVYLVMEYLIGGDVKSLLHIYGYFDEEMAVKYISEVALALDYLHRHGIIHRDLKPDNMLISNEGHIKLTDFGLSKVTLNRDINMMDILTTPSMAKPRQDYSRTPGQVLSLISSLGFNTPIAEKNQDPANILSACLSETSQLSQGLVCPMSVDQKDTTPYSSKLLKSCLETVASNPGMPVKCLTSNLLQSRKRLATSSASSQSHTFISSVESECHSSPKWEKDCQESDEALGPTMMSWNAVEKLCAKSANAIETKGFNKKDLELALSPIHNSSALPTTGRSCVNLAKKCFSGEVSWEAVELDVNNINMDTDTSQLGFHQSNQWAVDSGGISEEHLGKRSLKRNFELVDSSPCKKIIQNKKTCVEYKHNEMTNCYTNQNTGLTVEVQDLKLSVHKSQQNDCANKENIVNSFTDKQQTPEKLPIPMIAKNLMCELDEDCEKNSKRDYLSSSFLCSDDDRASKNISMNSDSSFPGISIMESPLESQPLDSDRSIKESSFEESNIEDPLIVTPDCQEKTSPKGVENPAVQESNQKMLGPPLEVLKTLASKRNAVAFRSFNSHINASNNSEPSRMNMTSLDAMDISCAYSGSYPMAITPTQKRRSCMPHQQTPNQIKSGTPYRTPKSVRRGVAPVDDGRILGTPDYLAPELLLGRAHGPAVDWWALGVCLFEFLTGIPPFNDETPQQVFQNILKRDIPWPEGEEKLSDNAQSAVEILLTIDDTKRAGMKELKRHPLFSDVDWENLQHQTMPFIPQPDDETDTSYFEARNTAQHLTVSGFSL

SEQ ID NO: 51423 - protein, 878 aa, Homo sapiens
  Payload ID: 10249
  Gene Symbol: MASTL
  Gene Name: microtubule associated serine/threonine kinase-like
  Uniprot ID: Q96GX5
  ENSP ID: ENSP00000365113
MDPTAGSKKEPGGGAATEEGVNRIAVPKPPSIEEFSIVKPISRGAFGKVYLGQKGGKLYAVKVVKKADMINKNMTHQVQAERDALALSKSPFIVHLYYSLQSANNVYLVMEYLIGGDVKSLLHIYGYFDEEMAVKYISEVALALDYLHRHGIIHRDLKPDNMLISNEGHIKLTDFGLSKVTLNRDINMMDILTTPSMAKPRQDYSRTPGQVLSLISSLGFNTPIAEKNQDPANILSACLSETSQLSQGLVCPMSVDQKDTTPYSSKLLKSCLETVASNPGMPVKCLTSNLLQSRKRLATSSASSQSHTFISSVESECHSSPKWEKDCQESDEALGPTMMSWNAVEKLCAKSANAIETKGFNKKDLELALSPIHNSSALPTTGRSCVNLAKKCFSGEVSWEAVELDVNNINMDTDTSQLGFHQSNQWAVDSGGISEEHLGKRSLKRNFELVDSSPCKKIIQNKKTCVEYKHNEMTNCYTNQNTGLTVEVQDLKLSVHKSQQNDCANKENIVNSFTDKQQTPEKLPIPMIAKNLMCELDEDCEKNSKRDYLSSSFLCSDDDRASKNISMNSDSSFPGISIMESPLESQPLDSDRSIKESSFEESNIEDPLIVTPDCQEKTSPKGVENPAVQESNQKMLGPPLEVLKTLASKRNAVAFRSFNSHINASNNSEPSRMNMTSLDAMDISCAYSGSYPMAITPTQKRRSCMPHQTPNQIKSGTPYRTPKSVRRGVAPVDDGRILGTPDYLAPELLLGRAHGPAVDWWALGVCLFEFLTGIPPFNDETPQQVFQNILKRDIPWPEGEEKLSDNAQSAVEILLTIDDTKRAGMKELKRHPLFSDVDWENLQHQTMPFIPQPDDETDTSYFEARNTAQHLTVSGFSL

SEQ ID NO: 51424 - protein, 479 aa, Homo sapiens
  Payload ID: 10249
  Gene Symbol: MASTL
  Gene Name: microtubule associated serine/threonine kinase-like
  ENSP ID: ENSP00000478938
ESDEALGPTMMSWNAVEKLCAKSANAIETKGFNKKDLELALSPIHNSSALPTTGRSCVNLAKKCFSGEVSWEAVELDVNNINMDTDTSQLGFHQSNQWAVDSGGISEEHLGKRSLKRNFELVDSSPCKKIIQNKKTCVEYKHNEMTNCYTNQNTGLTVEVQDLKLSVHKSQQNDCANKENIVNSFTDKQQTPEKLPIPMIAKNLMCELDEDCEKNSKRDYLSSSFLCSDDDRASKNISMNSDSSFPGISIMESPLESQPLDSDRSIKESSFEESNIEDPLIVTPDCQEKTSPKGVENPAVQESNQKMLGPPLEVLKTLASKRNAVAFRSFNSHINASNNSEPSRMNMTSLDAMDISCAYSGSYPMAITPTQKRRSCMPHQQTPNQIKSGTPYRTPKSVRRGVAPVDDGRILGTPDYLAPELLLGRAHELKRHPLFSDVDWENLQHQTMPFIPQPDDETDTSYFEARNTAQHLTVSGFSL

SEQ ID NO: 51425 - protein, 1270 aa, Homo sapiens
  Payload ID: 10250
  Gene Symbol: MTUS1
  Gene Name: microtubule associated tumor suppressor 1
  Uniprot ID: Q9ULD2
  ENSP ID: ENSP00000262102
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSGKPTSLKTAQSSWVNLPRPLPKSKASLKSPALRRTGSTPSIASTHSELSTYSNNSGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 51426 - protein, 436 aa, Homo sapiens
  Payload ID: 10250
  Gene Symbol: MTUS1
  Gene Name: microtubule associated tumor suppressor 1
  Uniprot ID: Q9ULD2
  ENSP ID: ENSP00000297488
MLLSPKFSLSTIHIRLTAKGLLRNLRLPSGFRRSTVVFHTVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 51427 - protein, 517 aa, Homo sapiens
  Payload ID: 10250
  Gene Symbol: MTUS1
  Gene Name: microtubule associated tumor suppressor 1
  Uniprot ID: Q9ULD2
  ENSP ID: ENSP00000371285
MTVPGGFRSCTETDISSKIFINSTLTPPAGSERHYDATLLTLLVVGSYSLCIIPLLATFTGKKTGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 51428 - protein, 1216 aa, Homo sapiens
  Payload ID: 10250
  Gene Symbol: MTUS1
  Gene Name: microtubule associated tumor suppressor 1
  Uniprot ID: Q9ULD2
  ENSP ID: ENSP00000371293
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSAGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 51429 - protein, 1216 aa, Homo sapiens; identical to SEQ ID NO: 51428
  Payload ID: 10250
  Gene Symbol: MTUS1
  Gene Name: microtubule associated tumor suppressor 1
  Uniprot ID: Q9ULD2
  ENSP ID: ENSP00000430167

SEQ ID NO: 51430 - protein, 505 aa, Homo sapiens
  Payload ID: 10250
  Gene Symbol: MTUS1
  Gene Name: microtubule associated tumor suppressor 1
  ENSP ID: ENSP00000431016
  MOD_RES (1)..(1): Any amino acid
XSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSVLPKAAFS

SEQ ID NO: 51431 - protein, 415 aa, Homo sapiens
  Payload ID: 10250
  Gene Symbol: MTUS1
  Gene Name: microtubule associated tumor suppressor 1
  Uniprot ID: Q9ULD2
  ENSP ID: ENSP00000445738
MKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 51432 - protein, 41 aa, Homo sapiens
  Payload ID: 10250
  Gene Symbol: MTUS1
  Gene Name: microtubule associated tumor suppressor 1
  ENSP ID: ENSP00000489015
MGCPSSKLCLYSPCAATRREEALKQHKTLSQELVNLRGELA

SEQ ID NO: 51433 - protein, 342 aa, Homo sapiens
  Payload ID: 10250
  Gene Symbol: MTUS1
  Gene Name: microtubule associated tumor suppressor 1
  ENSP ID: ENSP00000489288
MGCPSSKLCLYSPCAATRREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 51434 - protein, 348 aa, Homo sapiens
  Payload ID: 10251
  Gene Symbol: MTUS2
  Gene Name: microtubule associated tumor suppressor candidate 2
  Uniprot ID: Q5JR59
  ENSP ID: ENSP00000370186
MGHCCCKPYNCLQCLDKTNESALVKEKELSIELANIRDEVAFHTAKCEKLQKEKEELERRFEDEVKRLGWQQQAELQELEERLQLQFEAEMARLQEEHGDQLLSIRCQHQEQVEDLTASHDAALLEMENNHTVAITILQDDHDHKVQELMSTHELEKKELEENFEKLRLSLQDQVDTLTFQSQSLRDRARRFEEALRKNTEEQLEIALAPYQHLEEDMKSLKQVLEMKNQQIHEQEKKILELEKLAEKNIILEEKIQVLQQQNEDLKARIDQNTVVTRQLSEENANLQEYVEKETQEKKRLSRTNEELLWKLQTGDPTSPIKLSPTSPVYRGSSSGPSSPARVSTTPR

SEQ ID NO: 51435 - protein, 1379 aa, Homo sapiens
  Payload ID: 10251
  Gene Symbol: MTUS2
  Gene Name: microtubule associated tumor suppressor candidate 2
  ENSP ID: ENSP00000392057
MASSPTKGLTMSVPVAPKKSCYTQLRDNRNAARNNNESILSLGDTNANQIMLEVSSSHDESKTCDLGDEIGNTNSSEPENRTHFHKEFHQLQGFGKGSQAGSASLKDFRLSSTIQRELNEEHTVERGTDSLQTTRSIQGPSLSSWRNVMSEASLDVLAKRDAEIPRHVPKDKLAKTLDNEELRRHSLERASSSVAAVGSLTPQHPQPLSLDSREARGQIPGGGEGPQKTLPDHAVPAAFPATDSTSEGKSVRHPKPSTSESKQSTPSETQTVGAHVLQVCSEHTSHSAHPEPALNLTLASKEIPSKLEAQLGQGKGEAKLDLKYVPPRRVEQEGKAAQEGYLGCHKEENLSALEGRDPCGEAHPEATDALGHLLNSDLHHLGVGRGNCEEKRGVNPGEQDSLHTTPKQGSASLGGADNQPTGKISPCAGEKLGERTSSSFSPGDSHVAFIPNNLTDSKPLDVIEEERRLGSGNKDSVMVLVFNPSVGENKTEVPEPLDPQSGRSEARESKEVTTSVAENRNLLENADKIESTSARADSVLNIPAPLHPETTVNMTYQPTTPSSSFQDVSVFGMDAGSPLVVPPPTDSARLLNTSPKVPDKNTCPSGIPKPVFTHSKDTPSSQEGMENYQVEKTEERTETKPIIMPKPKHVRPKIITYIRRNPQALGQVDASLVPVGLPYAPPTCTMPLPHEEKAAGGDLKPSANLYEKFKPDLQKPRVFSSGLMVSGIKPPGHPFSQMSEKFLQEVTDHPGKEEFCSPPYAHYEVPPTFYRSAMLLKPQLGLGAMSRLPSAKSRILIASQRSSASAIHPPGPITTATSLYSSDPSADLKKASSSNAAKSNLPKSGLRPPGYSRLPAAKLAAFGFVRSSSVSSVSSTQSGDSAQPEQGRPATRSTFGNEEQPVLKASLPSKDTPKGAGRVAPPASSSVTAPRRSLLPAPKSTSTPAGTKKDAQKDQDTNKPAVSSPKRVAASTTKLHSPGYPKQRTAAARNGFPPKPDPQAREAERQLVLRLKERCEQQTRQLGVAQGELKRAICGFDALAVATQHFFRKNESALVKEKELSIELANIRDEVAFHTAKCEKLQKEKEELERRFEDEVKRLGWQQQAELQELEERLQLQFEAEMARLQEEHGDQLLSIRCQHQEQVEDLTASHDAALLEMENNHTVAITILQDDHDHKVQELMSTHELEKKELEENFEKLRLSLQDQVDTLTFQSQSLRDRARRFEEALRKNTEEQLEIALAPYQHLEEDMKSLKQVLEMKNQQIHEQEKKILELEKLAEKNIILEEKIQVLQQQNEDLKARIDQNTVVTRQLSEENANLQEYVEKETQEKKRLSRTNEELLWKLQTGDPTSPIKLSPTSPVYRGSSSGPSSPARVSTTPR

SEQ ID NO: 51436 - protein, 258 aa, Homo sapiens
  Payload ID: 10251
  Gene Symbol: MTUS2
  Gene Name: microtubule associated tumor suppressor candidate 2
  Uniprot ID: Q5JR59
  ENSP ID: ENSP00000445403
MARLQEEHGDQLLSIRCQHQEQVEDLTASHDAALLEMENNHTVAITILQDDHDHKVQELMSTHELEKKELEENFEKLRLSLQDQVDTLTFQSQSLRDRARRFEEALRKNTEEQLEIALAPYQHLEEDMKSLKQVLEMKNQQIHEQEKKILELEKLAEKNIILEEKIQVLQQQNEDLKARIDQNTVVTRQLSEENANLQEYVEKETQEKKRLSRTNEELLWKLQTGDPTSPIKLSPTSPVYRGSSSGPSSPARVSTTPR

SEQ ID NO: 51437 - protein, 1379 aa, Homo sapiens; identical to SEQ ID NO: 51435
  Payload ID: 10251
  Gene Symbol: MTUS2
  Gene Name: microtubule associated tumor suppressor candidate 2
  ENSP ID: ENSP00000483729

SEQ ID NO: 51438 - protein, 1905 aa, Homo sapiens
  Payload ID: 10252
  Gene Symbol: MTCL1
  Gene Name: microtubule crosslinking factor 1
  Uniprot ID: Q9Y4B5
  ENSP ID: ENSP00000305027
METLNGPAGGGAPDAKLQPPGQHHRHHHLHPVAERRRLHRAPSPARPFLKDLHARPAAPGPAVPSSGRAPAPAAPRSPNLAGKAPPSPGSLAAPGRLSRRSGGVPGAKDKPPPGAGARAAGGAKAALGSRRAARVAPAEPLSRAGKPPGAEPPSAAAKGRKAKRGSRAPPARTVGPPTPAARIPAVTLAVTSVAGSPARCSRISHTDSSSDLSDCPSEPLSDEQRLLPAASSDAESGTGSSDREPPRGAPTPSPAARGAPPGSPEPPALLAAPLAAGACPGGRSIPSGVSGGFAGPGVAEDVRGRSPPERPVPGTPKEPSLGEQSRLVPAAEEEELLREMEELRSENDYLKDELDELRAEMEEMRDSYLEEDVYQLQELRRELDRANKNCRILQYRLRKAEQKSLKVAETGQVDGELIRSLEQDLKVAKDVSVRLHHELKTVEEKRAKAEDENETLRQQMIEVEISKQALQNELERLKESSLKRRSTREMYKEKKTFNQDDSADLRCQLQFAKEEAFLMRKKMAKLGREKDELEQELQKYKSLYGDVDSPLPTGEAGGPPSTREAELKLRLKLVEEEANILGRKIVELEVENRGLKAEMEDMRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGDGLSPLPHLTESSSFLSTVTSVSRDSPIGNLGKELGPDLQSRLKEQLEWQLGPARGDERESLRLRAARELHRRADGDTGSHGLGGQTCFSLEMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQLEEKTENKLGELGSSAESKGALKKEREVHQKLLADSHSLVMDLRWQIHHSEKNWNREKVELLDRLDRDRQEWERQKKEFLWRIEQLQKENSPRRGGSFLCDQKDGNVRPFPHQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRTSPGMAQKGYSESAWARSTTTRESPVHTTINDGLSSLFNIIDHSPVVQDPFQKGLRAGSRSRSAEPRPELGPGQETGTNSRGRSPSPIGVGSEMCREEGGEGTPVKQDLSAPPGYTLTENVARILNKKLLEHALKEERRQAAHGPPGLHSDSHSLGDTAEPGPMENQTVLLTAPWGL

SEQ ID NO: 51439 - protein, 1586 aa, Homo sapiens
  Payload ID: 10252
  Gene Symbol: MTCL1
  Gene Name: microtubule crosslinking factor 1
  Uniprot ID: Q9Y4B5
  ENSP ID: ENSP00000352927
MEEMRDSYLEEDVYQLQELRRELDRANKNCRILQYRLRKAEQKSLKVAETGQVDGELIRSLEQDLKVAKDVSVRLHHELKTVEEKRAKAEDENETLRQQMIEVEISKQALQNELERLKESSLKRRSTREMYKEKKTFNQDDSADLRCQLQFAKEEAFLMRKKMAKLGREKDELEQELQKYKSLYGDVDSPLPTGEAGGPPSTREAELKLRLKLVEEEANILGRKIVELEVENRGLKAEMEDMRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGDGLSPLPHLTESSSFLSTVTSVSRDSPIGNLGKELGPDLQSRLKEQLEWQLGPARGDERESLRLRAARELHRRADGDTGSHGLGGQTCFSLELRGPPVLPEQSVSIEELQGQLVQAARLHQEETETFTNKIHKMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQLEEKTENKLGELGSSAESKGALKKEREVHQKLLADSHSLVMDLRWQIHHSEKNWNREKVELLDRLDRDRQEWERQKKEFLWRIEQLQKENSPRRGGSFLCDQKDGNVRPFPHQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRTSPGMAQKGYSESAWARSTTTRESPVHTTINDGLSSLFNIIDHSPVVQDPFQKGLRAGSRSRSAEPRPELGPGQETGTNSRGRSPSPIGVGSEMCREEGGEGTPVKQDLSAPPGYTLTENVARILNKKLLEHALKEERRQAAHGPPGLHSDSHSLGDTAEPGPMENQTVLLTAPWGL

SEQ ID NO: 51440 - protein, 1586 aa, Homo sapiens; identical to SEQ ID NO: 51439
  Payload ID: 10252
  Gene Symbol: MTCL1
  Gene Name: microtubule crosslinking factor 1
  Uniprot ID: Q9Y4B5
  ENSP ID: ENSP00000382924

SEQ ID NO: 51441 - protein, 1545 aa, Homo sapiens
  Payload ID: 10252
  Gene Symbol: MTCL1
  Gene Name: microtubule crosslinking factor 1
  Uniprot ID: Q9Y4B5
  ENSP ID: ENSP00000429556
MEEMRDSYLEEDVYQLQELRRELDRANKNCRILQYRLRKAEQKSLKVAETGQVDGELIRSLEQDLKVAKDVSVRLHHELKTVEEKRAKAEDENETLRQQMIEVEISKQALQNELERLKESSLKRRSTREMYKEKKTFNQDDSADLRCQLQFAKEEAFLMRKKMAKLGREKDELEQELQKYKSLYGDVDSPLPTGEAGGPPSTREAELKLRLKLVEEEANILGRKIVELEVENRGLKAEMEDMRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGDGLSPLPHLTESSSFLSTVTSVSRDSPIGNLGKELGPDLQSRLKEQLEWQLGPARGDERESLRLRAARELHRRADGDTGSHGLGGQTCFSLEMEEEHLYALRWKELEMHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQLEEKTENKLGELGSSAESKGALKKEREVHQKLLADSHSLVMDLRWQIHHSEKNWNREKVELLDRLDRDRQEWERQKKEFLWRIEQLQKENSPRRGGSFLCDQKDGNVRPFPHQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRTSPGMAQKGYSESAWARSTTTRESPVHTTINDGLSSLFNIIDHSPVVQDPFQKGLRAGSRSRSAEPRPELGPGQETGTNSRGRSPSPIGVGSEMCREEGGEGTPVKQDLSAPPGYTLTENVARILNKKLLEHALKEERRQAAHGPPGLHSDSHSLGDTAEPGPMENQTVLLTAPWGL

SEQ ID NO: 51442 - protein, 509 aa, Homo sapiens
  Payload ID: 10252
  Gene Symbol: MTCL1
  Gene Name: microtubule crosslinking factor 1
  ENSP ID: ENSP00000463438
MRKKMAKLGREKDELEQELQKYKSLYGDVDSPLPTGEAGGPPSTREAELKLRLKLVEEEANILGRKIVELEVENRGLKAEMEDMRGQQEREGPGRDHAPSIPTSPFGDSLESSTELRRHLQFVEEEAELLRRSISEIEDHNRQLTHELSKFKFEPPREPGWLGEGASPGAGGGAPLQEELKSARLQISELSGKVLKLQHENHALLSNIQRCDLAAHLGLRAPSPRDSDAESDAGKKESDGEESRLPQPKREGPVGGESDSEEMFEKTSGFGSGKPSEASEPCPTELLKAREDSEYLVTLKHEAQRLERTVERLITDTDSFLHDAGLRGGAPLPGPGLQGEEEQGEGDQQEPQLLGTINAKMKAFKKELQAFLEQVNRIGDGLSPLPHLTESSSFLSTVTSVSRDSPIGNLGKELGPDLQMCPPAPLLILILVQTERAAGVAARAGPRGRAGEPAPPSRAGAAPPRRRGHREPRAGRPDLLQPGDGGGAPLCLEVERTGNAQPGFAKHPP

SEQ ID NO: 51443 - protein, 976 aa, Homo sapiens
  Payload ID: 10252
  Gene Symbol: MTCL1
  Gene Name: microtubule crosslinking factor 1
  Uniprot ID: Q9Y4B5
  ENSP ID: ENSP00000463465
MHSLALQNTLHERTWSDEKNLMQQELRSLKQNIFLFYVKLRWLLKHWRQGKQMEEEGEEFTEGEHPETLSRLGELGVQGGHQADGPDHDSDRGCGFPVGEHSPHSRVQIGDHSLRLQTADRGQPHKQVVENQQLFSAFKALLEDFRAELREDERARLRLQQQYASDKAAWDVEWAVLKCRLEQNCCGYPRINIEEETLGFTRLPAGSTVKTLKSLGLQRLELEEKTENKLGELGSSAESKGALKKEREVHQKLLADSHSLVMDLRWQIHHSEKNWNREKVELLDRLDRDRQEWERQKKEFLWRIEQGSLRMPRPVAMWPCADADSIPFEDRPLSKLKESDRCSASENLYLDALSLDDEPEEPPAHRPEREFRNRLPEEEENHKGNLQRAVSVSSMSEFQRLMDISPFLPEKGLPSTSSKEDVTPPLSPDDLKYIEEFNKSWDYTPNRGHNGGGPDLWADRTEVGRAGHEDSTEPFPDSSWYLTTSVTMTTDTMTSPEHCQKQPLRSHVLTEQSGLRVLHSPPAVRRVDSITAAGGEGPFPTSRARGSPGDTKGGPPEPMLSRWPCTSPRHSRDYVEGARRPLDSPLCTSLGFASPLHSLEMSKNLSDDMKEVAFSVRNAICSGPGELQVKDMACQTNGSRTMGTQTVQTISVGLQTEALRGSGVTSSPHKCLTPKAGGGATPVSSPSRSLRSRQVAPAIEKVQAKFERTCCSPKYGSPKLQRKPLPKADQPNNRTSPGMAQKGYSESAWARSTTTRESPVHTTINDGLSSLFNIIDHSPVVQDPFQKGLRAGSRSRSAEPRPELGPGQETGTNSRGRSPSPIGVGSEMCREEGGEGTPVKQDLSAPPGYTLTENVARILNKKLLEHALKEERRQAAHGPPGLHSDSHSLGDTAEPGPMEELPCSALAPSLEPCFSRPERPANRRPPSRWAPHSPTASQPQSPGDPTSLEEHGGEEPPEEQPHRDASLHGLSQYNSL

SEQ ID NO: 51444 - protein, 47 aa, Homo sapiens
  Payload ID: 10252
  Gene Symbol: MTCL1
  Gene Name: microtubule crosslinking factor 1
  ENSP ID: ENSP00000463506
MEEMRDSYLEEDVYQLQELRRELDRANKNCRILQYRLRKAEQKSLKV

SEQ ID NO: 51445 - protein, 5938 aa, Homo sapiens
  Payload ID: 10253
  Gene Symbol: MACF1
  Gene Name: microtubule-actin crosslinking factor 1
  Uniprot ID: Q9UPN3
  ENSP ID: ENSP00000289893
MQKGLLDQDTGLVLLESQVIMSGLIAPETGENLSLEEGIARNLINPQMYQQLRELQDALALISRLTESRGPLSVVEAIEKRIISETVGLKILEAHLATGGFSLSPSENCINLEEAFHQGLISAWLHSVLESYLRTSKNLIDPNTAEKIGLLDLMQRCIVHQESGFKLLPVKQLAGGMVSLKSGRKVSIFRAVQEGLIDRQVTVRLLEAQLFAGGIVDPRTGHRLTVEEAVRHNLIDQDMACAILIRQLQTGGIIDTVTGQRLTIDEAVSNDLVAAKIALVILESLWSFMGLLWPESGEILPITDALEQGIVSTELAHKILSNRQHIKALFLPATTEILSWKKAIESGILDRDLANNLKSICIPDVMPHMQLADSAEQNINPGAAVLPCSKSHPKATASQSENLLFQLMTHSYINVQNGQRLLLLDKELMETLTSRDEYQTSPPKVVEIGHQRQKTPEGLQESANVKISGTFSSGWTVRLPEFQFSSQNKEYPDREDCTTEKGKKTTVETEDSSVENPEQDLFVEQKERNPNIDALKVINKVKLEVQRQLIGTQREDQTAVSVRENASRGHLLTIPPAEAEGVPLVVDKDVFSVETPKKEHQPLRNTSFTCQNEQAHTLETEYIHDETGGSHIKPQSKKLQVQVKKTLGIKLELKSETDGNVHPLDKKEMLKKTFLAKDDHKESQEAQNIAGGSMMMSEKTDEEDSGREIFLSCSHPLELLEEATLNVLSAQLLDGGIFHEQTGQKLLLNEAISRGIVPSHTAVKLMEKLNMFQGFFDSQTCESLTTEEVINEGLMDEKLLHNVLMADKAISGVLDPRTQTLCSVKDAVTVGLLDKETATRILERQVVTGGIIDLKRGKKVSVTLASTLGLVDVADQPELINLEKASKGRDAEKTVRERLISLQMETTGLIDPDSKAPLTVVQSIDRGLLEREEAVRLLTKQVVDGGIIHHISGMRLSVDNAFRHGLIGEDLAEKLKRVENLNIHQIFNPETKENISLPKAIKLDLITSDLKREIQEVQAFTGNFVDLISGQRLTLAEAKKEGLLTNEAVLSPGMMHGIVDPENCRIVPYSELVKKCKIDIESGQRYLEVIPFSDIKDGVSDKVLTLSQAIQLGKVDFASTLKVLEAQANTGGIIDTATGKRLTLASALEEKLVDENMVRIIASHQVLNGGIVDIFSDQRVTLVEAIEKRLISPELANMIQIDSSEFSDHRAQIEKQEGIEVCALQNEFLGKDMLIACNQTAEMSCNKVEESERLFQVENQSAQEKVKVRVSDGEQAKKSREISLKEFGCKDQRKPRMSSDAKEFISIINPHNLKGKSLGQVSLTHPYSECDFKLKEVARNNMGNDTNEEQEKAVTKIEIISHMKQSTSCLDSEEIRENQGEVILEVQETYCETSGKLPSEQVLQQPMNARVKSKREKREVIVEESIRTCKPAFLSEEKLYQETAIRDEHDSHIKSQPREMTSSEKGKEADTEMGFSITFKIEESSSQVVPQGISVKHLDALTLFSSKQANEGKVNNLSLCLTLKPEENLSREIACGAQSEPFPCMTPRPEGLHYQESDGKAQVTGPSQISKTDKSFQGTTRQETNYQDSWVTSKTKETKHQISSSNECKEKSYQEVSFDPARGLKLEEITVSRPDSKEVRYLEFSDRKDLHHQGSKSDDKLCGTLKSEIATQELTGEKFLEMANPNVAGLEAGSIEDIVTQRGSRVLGSFLPEKLFKGVSQKENTGQQNAIISPTVLETSEEKTVSLTVCSAVKTEKTPQEKLRESPGSEQTPFMTAPEGKGNGGVNPEPFRATQNVFTRQLCLEHDEKLVSYLSLLRNIEMRTKQIQPLELNLAELQDLLCQAKVLERELKDLTTLVSQELECVNQIIISQPQEVPAQLLKALEKDAKNLQKSLSSVSDTWNSRLLHFQNAVEIEKTKVLNQHTQLEGRLQDLRAWVGNKNLILNSKGSNSEIDVDSLNLCLQQYEDLKQPMAERKAQLDALAFDIQFFISEHAQDLSPQQNRQMLRLLNELQRSFQDILEQTAAQVDALQGHLQQMEQEALVKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFFLGNQFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 51446 - protein, 543 aa, Homo sapiens
  Payload ID: 10253
  Gene Symbol: MACF1
  Gene Name: microtubule-actin crosslinking factor 1
  ENSP ID: ENSP00000353231
  MOD_RES (1)..(1): Any amino acid
XRFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEEQLCLELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFFLGNQFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 51447 - protein, 5430 aa, Homo sapiens
  Payload ID: 10253
  Gene Symbol: MACF1
  Gene Name: microtubule-actin crosslinking factor 1
  Uniprot ID: Q9UPN3
  ENSP ID: ENSP00000354573
MSSSDEETLSERSCRSERSCRSERSYRSERSGSLSPCPPGDTLPWNLPLHEQKKRKSQDSVLDPAERAVVRVADERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 51448 - protein, 7388 aa, Homo sapiens
  Payload ID: 10253
  Gene Symbol: MACF1
  Gene Name: microtubule-actin crosslinking factor 1
  Uniprot ID: Q9UPN3
  ENSP ID: ENSP00000362006
MSSSDEETLSERSCRSERSCRSERSYRSERSGSLSPCPPGDTLPWNLPLHEQKKRKSQDSVLDPAERAVVRVADERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKECRAVAGVIDLGTVEIFPIFKAMQKGLLDQDTGLVLLESQVIMSGLIAPETGENLSLEEGIARNLINPQMYQQLRELQDALALISRLTESRGPLSVVEAIEKRIISETVGLKILEAHLATGGFSLSPSENCINLEEAFHQGLISAWLHSVLESYLRTSKNLIDPNTAEKIGLLDLMQRCIVHQESGFKLLPVKQLAGGMVSLKSGRKVSIFRAVQEGLIDRQVTVRLLEAQLFAGGIVDPRTGHRLTVEEAVRHNLIDQDMACAILIRQLQTGGIIDTVTGQRLTIDEAVSNDLVAAKIALVILESLWSFMGLLWPESGEILPITDALEQGIVSTELAHKILSNRQHIKALFLPATTEILSWKKAIESGILDRDLANNLKSICIPDVMPHMQLADSAEQNINPGAAVLPCSKSHPKATASQSENLLFQLMTHSYINVQNGQRLLLLDKELMETLTSRDEYQTSPPKVVEIGHQRQKTPEGLQESANVKISGTFSSGWTVRLPEFQFSSQNKEYPDREDCTTEKGKKTTVETEDSSVENPEQDLFVEQKERNPNIDALKVINKVKLEVQRQLIGTQREDQTAVSVRENASRGHLLTIPPAEAEGVPLVVDKDVFSVETPKKEHQPLRNTSFTCQNEQAHTLETEYIHDETGGSHIKPQSKKLQVQVKKTLGIKLELKSETDGNVHPLDKKEMLKKTFLAKDDHKESQEAQNIAGGSMMMSEKTDEEDSGREIFLSCSHPLELLEEATLNVLSAQLLDGGIFHEQTGQKLLLNEAISRGIVPSHTAVKLMEKLNMFQGFFDSQTCESLTTEEVINEGLMDEKLLHNVLMADKAISGVLDPRTQTLCSVKDAVTVGLLDKETATRILERQVVTGGIIDLKRGKKVSVTLASTLGLVDVADQPELINLEKASKGRDAEKTVRERLISLQMETTGLIDPDSKAPLTVVQSIDRGLLEREEAVRLLTKQVVDGGIIHHISGMRLSVDNAFRHGLIGEDLAEKLKRVENLNIHQIFNPETKENISLPKAIKLDLITSDLKREIQEVQAFTGNFVDLISGQRLTLAEAKKEGLLTNEAVLSPGMMHGIVDPENCRIVPYSELVKKCKIDIESGQRYLEVIPFSDIKDGVSDKVLTLSQAIQLGKVDFASTLKVLEAQANTGGIIDTATGKRLTLASALEEKLVDENMVRIIASHQVLNGGIVDIFSDQRVTLVEAIEKRLISPELANMIQIDSSEFSDHRAQIEKQEGIEVCALQNEFLGKDMLIACNQTAEMSCNKVEESERLFQVENQSAQEKVKVRVSDGEQAKKSREISLKEFGCKDQRKPRMSSDAKEFISIINPHNLKGKSLGQVSLTHPYSECDFKLKEVARNNMGNDTNEEQEKAVTKIEIISHMKQSTSCLDSEEIRENQGEVILEVQETYCETSGKLPSEQVLQQPMNARVKSKREKREVIVEESIRTCKPAFLSEEKLYQETAIRDEHDSHIKSQPREMTSSEKGKEADTEMGFSITFKIEESSSQVVPQGISVKHLDALTLFSSKQANEGKVNNLSLCLTLKPEENLSREIACGAQSEPFPCMTPRPEGLHYQESDGKAQVTGPSQISKTDKSFQGTTRQETNYQDSWVTSKTKETKHQISSSNECKEKSYQEVSFDPARGLKLEEITVSRPDSKEVRYLEFSDRKDLHHQGSKSDDKLCGTLKSEIATQELTGEKFLEMANPNVAGLEAGSIEDIVTQRGSRVLGSFLPEKLFKGVSQKENTGQQNAIISPTVLETSEEKTVSLTVCSAVKTEKTPQEKLRESPGSEQTPFMTAPEGKGNGGVNPEPFRATQNVFTRQLCLEHDEKLVSYLSLLRNIEMRTKQIQPLELNLAELQDLLCQAKVLERELKDLTTLVSQELECVNQIIISQPQEVPAQLLKALEKDAKNLQKSLSSVSDTWNSRLLHFQNAVEIEKTKVLNQHTQLEGRLQDLRAWVGNKNLILNSKGSNSEIDVDSLNLCLQQYEDLKQPMAERKAQLDALAFDIQFFISEHAQDLSPQQNRQMLRLLNELQRSFQDILEQTAAQVDALQGHLQQMEQEALVKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 51449 - protein, 4434 aa, Homo sapiens
  Payload ID: 10253
  Gene Symbol: MACF1
  Gene Name: microtubule-actin crosslinking factor 1
  ENSP ID: ENSP00000362016
  MOD_RES (1)..(1): Any amino acid
XKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 51450 - protein, 455 aa, Homo sapiens
  Payload ID: 10253
  Gene Symbol: MACF1
  Gene Name: microtubule-actin crosslinking factor 1
  ENSP ID: ENSP00000391512
  MOD_RES (1)..(1): Any amino acid
XILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFFLGNQFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKTSLQFSRCYDKPWLVNSKAGTPIRDSHSPDLQLPTPEVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 51451 - protein, 368 aa, Homo sapiens
  Payload ID: 10253
  Gene Symbol: MACF1
  Gene Name: microtubule-actin crosslinking factor 1
  ENSP ID: ENSP00000407776
  MOD_RES (1)..(1): Any amino acid
XGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKTSLQFSRCYDKPWLVNSKAGTPIRDSHSPDLQLPTPEVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 51452 - protein, 159 aa, Homo sapiens
  Payload ID: 10253
  Gene Symbol: MACF1
  Gene Name: microtubule-actin crosslinking factor 1
  ENSP ID: ENSP00000412910
DKIEDEVTRQVAQCKCAKRFQVEQIGENKYRFGDSQQLRLVRILRSTVMVRVGGGWMALDEFLVKNDPCRVHHPGSKIKRSDSSSSISSQSPIARGRTNIELREKFILPEGASQGMTPFRSRGRRSKPSSRAASPTRSSSSASQSNHSCTSMPSSPATP

SEQ ID NO: 51453 - protein, 1427 aa, Homo sapiens
  Payload ID: 10253
  Gene Symbol: MACF1
  Gene Name: microtubule-actin crosslinking factor 1
  ENSP ID: ENSP00000431179
MGKPLSRPDCLRRNPSCLGKGEEEDGYIEDCYVPQRSIYDTMRINEQIDQGSKLNQTSKSTMEKMEGSTISSNGTLGAASNVFESRAPEGKKLDERIIFDALKLSSDVQKSAPVPPRRRPNAERKDNVNRRSWKSFMPPNFPEFAERIEASLSEVSEAGASNPSLQEKKESSSALTESSGHLDHREPQSESVTLEHVSKSIGIPEVQDFKNLSGDCQDFRFQQHSANPPHEFQPVESEAVATSGNTDVMQESRFSSATWPRATKSLAKGGFSEKQHPLGDTACTVEMPPLSPCLSEELLDPELHVLITPSLREKTESELKFEEDERWIMMEAEGEWEEEKLSDREKTFLMADEKNSLADIFEEREQANTAVVEDGSDCLAAVLRTFGHLSLGQICCPDDPQPAKDQLATVPKDIPLDCDCVLTGEDILGEVANRTAQGLEGLVSDSACTVGTIDAEQLSDTDSVQMFLELEKECLCEEGVTPLVELQNQISSEGLAASQDAENLLVISHFSGAALEKEQHLGLLHVRAKDYDTRLDCGYFNTLDSSQVPNAVELIAHVDIMRDTSTVSKEECEKVPFSPRTAEFKSRQPADLDSLEKLDPGGLLNSDHRVSHEEKLSGFIASELAKDNGSLSQGDCSQTEGNGEECIERVTFSFAFNHELTDVTSGPEVEVLYESNLLTDEIHLESGNVTVNQENNSLTSMGNVVTCELSVEKVCDEDGEAKELDYQATLLEDQAPAHFHRNFPEQVFQDLQRKSPESEILSLHLLVEELRLNPDGVETVNDTKPELNVASSEGGEMERRDSDSFLNIFPEKQVTKAGNTEPVLEEWIPVLQRPSRTAAVPTVKDALDAALPSPEEGTSIAAVPAPEGTAVVAALVPFPHEDILVASIVSLEEEDVTAAAVSAPERATVPAVTVSVPEGTAAVAAVSSPEETAPAVAAAITQEGMSAVAGFSPEWAALAITVPITEEDGTPEGPVTPATTVHAPEEPDTAAVRVSTPEEPASPAAAVPTPEEPTSPAAAVPTPEEPTSPAAAVPPPEEPTSPAAAVPTPEEPTSPAAAVPTPEEPTSPAAAVPTPEEPTSPAAAVPTPEEPTSPAAAVPTPEEPTSPAAAVPTPEEPASPAAAVPTPEEPASPAAAVPTPEEPAFPAPAVPTPEESASAAVAVPTPEESASPAAAVPTPAESASFAAVVATLEEPTSPAASVPTPAAMVATLEEFTSPAASVPTSEEPASLAAAVSNPEEPTSPAAAVPTLEEPTSSAAAVLTPEELSSPAASVPTPEEPASPAAAVSNLEEPASPAAAVPTPEVAAIPAASVPTPEVPAIPAAAVPPMEEVSPIGVPFLGVSAHTDSVPISEEGTPVLEEASSTGMWIKEDLDSLVFGIKEVTSTVLHGKVPLAATAGLNSDEVIVHFDSGKGLKSKVRFAGLTWW

SEQ ID NO: 51454 - protein, 362 aa, Homo sapiens
  Payload ID: 10253
  Gene Symbol: MACF1
  Gene Name: microtubule-actin crosslinking factor 1
  ENSP ID: ENSP00000433104
  MOD_RES (1)..(1): Any amino acid
XIPAASVPTPEVPAIPAAAVPPMEEVSPIGVPFLGVSAHTDSVPISEEGTPVLEEASSTGMWIKEDLDSLVFGIKEVTSTVLHGKVPLAATAGLNSDEMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQA

SEQ ID NO: 51455 - protein, 121 aa, Homo sapiens
  Payload ID: 10253
  Gene Symbol: MACF1
  Gene Name: microtubule-actin crosslinking factor 1
  ENSP ID: ENSP00000434859
MSSSDEETLSERSCRSERSCRSERSYRSERSGSLSPCPPGDTLPWNLPLHEQKKRKSQDSVLDPAERAVVRVADALPSTSFCFPHCSLLRNAAAVSPIRSKRKSKTKRRKPQSFCDCVVWL

SEQ ID NO: 51456 - protein, 1375 aa, Homo sapiens
  Payload ID: 10253
  Gene Symbol: MACF1
  Gene Name: microtubule-actin crosslinking factor 1
  ENSP ID: ENSP00000435070
MAGYVPGQQPANRSQEKEFVQAYEDVLERYKDERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEE

SEQ ID NO: 51457 - protein, 1062 aa, Homo sapiens
  Payload ID: 10253
  Gene Symbol: MACF1
  Gene Name: microtubule-actin crosslinking factor 1
  ENSP ID: ENSP00000435078
MGNSLGCFKEPKESIAIPEKAPISPKKRVRFKRRWRGKKIPTPEASHQEETSEGTGVIEETETLTKLTESLQKEDGVGGVEHTPPDILLPGDSAPNSRVVDRGMIVQVKERFQGEVQTAHLLLENESSVAGGVWDSLEEGMTVIAHLLDNPAERNCEKSVSQLVEFPRTASCSSRAVLLPLQGETAVEKGNIQRGFRSCALPRTDYPTDKGNQEQFSEGWSVEEGTKSVSGAPQTASWIIECSVSSLLLDQPGGQRRTEPSHVGQVPPQDSRLPTSQSDLSISGVTVSILPSSSGYGSDGPHIHGIQPKDTEPEKSSTSFSEEDGTLSLEASHTPSWGLEEISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMAQDEKEQLIQSKSSVASLVGRSKTIVQLKPRSPDHVLKNTISVKAVCDYRQIEGRTILSEGYGPLASAAC

SEQ ID NO: 51458 - protein, 113 aa, Homo sapiens
  Payload ID: 10253
  Gene Symbol: MACF1
  Gene Name: microtubule-actin crosslinking factor 1
  ENSP ID: ENSP00000435892
MPLLDSSYLPPTIFILTHVLGVAGVLYWKRHARGRADERDRVQKKTFTKWVNKHLMKVRKHINDLYEDLRDGHNLISLLEVLSGIKLPREKGRMRFHRLQNVQIALDFLKQRQ

SEQ ID NO: 51459 - protein, 2028 aa, Homo sapiens
  Payload ID: 10253
  Gene Symbol: MACF1
  Gene Name: microtubule-actin crosslinking factor 1
  ENSP ID: ENSP00000437059
MGNSLGCFKEPKESIAIPEKAPISPKKRVRFKRRWRGKKIPTPEASHQEETSEGTGVIEETETLTKLTESLQKEDGVGGVEHTPPDILLPGDSAPNSRVVDRGMIVQVKERFQGEVQTAHLLLENESSVAGGVWDSLEEGMTVIAHLLDNPAERNCEKSVSQLVEFPRTASCSSRAVLLPLQGETAVEKGNIQRGFRSCALPRTDYPTDKGNQEQFSEGWSVEEGTKSVSGAPQTASWIIECSVSSLLLDQPGGQRRTEPSHVGQVPPQDSRLPTSQSDLSISGVTVSILPSSSGYGSDGPHIHGIQPKDTEPEKSSTSFSEEDGTLSLEISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISG

SEQ ID NO: 51460 - protein, 7555 aa, Homo sapiens
  Payload ID: 10253
  Gene Symbol: MACF1
  Gene Name: microtubule-actin crosslinking factor 1
  ENSP ID: ENSP00000455274
MPLLDSSYLPPTIFILTHVLGVAGVLYWKRHARGRADERDRVQKKTFTKWVNKHLMKVRKHINDLYEDLRDGHNLISLLEVLSGIKLEPAGLKTLRLVSMPSWCHTNNEEQAEEDDDDVPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKECRAVAGVIDLGTVEIFPIFKAMQKGLLDQDTGLVLLESQVIMSGLIAPETGENLSLEEGIARNLINPQMYQQLRELQDALALISRLTESRGPLSVVEAIEKRIISETVGLKILEAHLATGGFSLSPSENCINLEEAFHQGLISAWLHSVLESYLRTSKNLIDPNTAEKIGLLDLMQRCIVHQESGFKLLPVKQLAGGMVSLKSGRKVSIFRAVQEGLIDRQVTVRLLEAQLFAGGIVDPRTGHRLTVEEAVRHNLIDQDMACAILIRQLQTGGIIDTVTGQRLTIDEAVSNDLVAAKIALVILESLWSFMGLLWPESGEILPITDALEQGIVSTELAHKILSNRQHIKALFLPATTEILSWKKAIESGILDRDLANNLKSICIPDVMPHMQLADSAEQNINPGAAVLPCSKSHPKATASQSENLLFQLMTHSYINVQNGQRLLLLDKELMETLTSRDEYQTSPPKVVEIGHQRQKTPEGLQESANVKISGTFSSGWTVRLPEFQFSSQNKEYPDREDCTTEKGKKTTVETEDSSVENPEQDLFVEQKERNPNIDALKVINKVKLEVQRQLIGTQREDQTAVSVRENASRGHLLTIPPAEAEGVPLVVDKDVFSVETPKKEHQPLRNTSFTCQNEQAHTLETEYIHDETGGSHIKPQSKKLQVQVKKTLGIKLELKSETDGNVHPLDKKEMLKKTFLAKDDHKESQEAQNIAGGSMMMSEKTDEEDSGREIFLSCSHPLELLEEATLNVLSAQLLDGGIFHEQTGQKLLLNEAISRGIVPSHTAVKLMEKLNMFQGFFDSQTCESLTTEEVINEGLMDEKLLHNVLMADKAISGVLDPRTQTLCSVKDAVTVGLLDKETATRILERQVVTGGIIDLKRGKKVSVTLASTLGLVDVADQPELINLEKASKGRDAEKTVRERLISLQMETTGLIDPDSKAPLTVVQSIDRGLLEREEAVRLLTKQVVDGGIIHHISGMRLSVDNAFRHGLIGEDLAEKLKRVENLNIHQIFNPETKENISLPKAIKLDLITSDLKREIQEVQAFTGNFVDLISGQRLTLAEAKKEGLLTNEAVLSPGMMHGIVDPENCRIVPYSELVKKCKIDIESGQRYLEVIPFSDIKDGVSDKVLTLSQAIQLGKVDFASTLKVLEAQANTGGIIDTATGKRLTLASALEEKLVDENMVRIIASHQVLNGGIVDIFSDQRVTLVEAIEKRLISPELANMIQIDSSEFSDHRAQIEKQEGIEVCALQNEFLGKDMLIACNQTAEMSCNKVEESERLFQVENQSAQEKVKVRVSDGEQAKKSREISLKEFGCKDQRKPRMSSDAKEFISIINPHNLKGKSLGQVSLTHPYSECDFKLKEVARNNMGNDTNEEQEKAVTKIEIISHMKQSTSCLDSEEIRENQGEVILEVQETYCETSGKLPSEQVLQQPMNARVKSKREKREVIVEESIRTCKPAFLSEEKLYQETAIRDEHDSHIKSQPREMTSSEKGKEADTEMGFSITFKIEESSSQVVPQGISVKHLDALTLFSSKQANEGKVNNLSLCLTLKPEENLSREIACGAQSEPFPCMTPRPEGLHYQESDGKAQVTGPSQISKTDKSFQGTTRQETNYQDSWVTSKTKETKHQISSSNECKEKSYQEVSFDPARGLKLEEITVSRPDSKEVRYLEFSDRKDLHHQGSKSDDKLCGTLKSEIATQELTGEKFLEMANPNVAGLEAGSIEDIVTQRGSRVLGSFLPEKLFKGVSQKENTGQQNAIISPTVLETSEEKTVSLTVCSAVKTEKTPQEKLRESPGSEQTPFMTAPEGKGNGGVNPEPFRATQNVFTRQLCLEHDEKLVSYLSLLRNIEMRTKQIQPLELNLAELQDLLCQAKVLERELKDLTTLVSQELECVNQIIISQPQEVPAQLLKALEKDAKNLQKSLSSVSDTWNSRLLHFQNAVEIEKTKVLNQHTQLEGRLQDLRAWVGNKNLILNSKGSNSEIDVDSLNLCLQQYEDLKQPMAERKAQLDALAFDIQFFISEHAQDLSPQQNRQMLRLLNELQRSFQDILEQTAAQVDALQGHLQQMEQEALVKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFFLGNQFGDSQQLRLVRILRSTVMVRVGGGWMALDEFLVKNDPCRVHHPGSKIKRSDSSSSISSQSPIARGRTNIELREKFILPEGASQGMTPFRSRGRRSKPSSRAASPTRSSSSASQSNHSCTSMPSSPATPASGTKTSLQFSRCYDKPWLVNSKAGTPIRDSHSPDLQLPTPEVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 51461 - protein, 7592 aa, Homo sapiens
  Payload ID: 10253
  Gene Symbol: MACF1
  Gene Name: microtubule-actin crosslinking factor 1
  ENSP ID: ENSP00000455823
MSSSDEETLSERSCRSERSCRSERSYRSERSGSLSPCPPGDTLPWNLPLHEQKKRKSQDSVLDPAERAVVRVADERDRVQKKTFTKWVNKHLMKVRKHINDLYEDLRDGHNLISLLEVLSGIKLEPAGLKTLRLVSMPSWCHTNNEEQAEEDDDDVPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKECRAVAGVIDLGTVEIFPIFKAMQKGLLDQDTGLVLLESQVIMSGLIAPETGENLSLEEGIARNLINPQMYQQLRELQDALALISRLTESRGPLSVVEAIEKRIISETVGLKILEAHLATGGFSLSPSENCINLEEAFHQGLISAWLHSVLESYLRTSKNLIDPNTAEKIGLLDLMQRCIVHQESGFKLLPVKQLAGGMVSLKSGRKVSIFRAVQEGLIDRQVTVRLLEAQLFAGGIVDPRTGHRLTVEEAVRHNLIDQDMACAILIRQLQTGGIIDTVTGQRLTIDEAVSNDLVAAKIALVILESLWSFMGLLWPESGEILPITDALEQGIVSTELAHKILSNRQHIKALFLPATTEILSWKKAIESGILDRDLANNLKSICIPDVMPHMQLADSAEQNINPGAAVLPCSKSHPKATASQSENLLFQLMTHSYINVQNGQRLLLLDKELMETLTSRDEYQTSPPKVVEIGHQRQKTPEGLQESANVKISGTFSSGWTVRLPEFQFSSQNKEYPDREDCTTEKGKKTTVETEDSSVENPEQDLFVEQKERNPNIDALKVINKVKLEVQRQLIGTQREDQTAVSVRENASRGHLLTIPPAEAEGVPLVVDKDVFSVETPKKEHQPLRNTSFTCQNEQAHTLETEYIHDETGGSHIKPQSKKLQVQVKKTLGIKLELKSETDGNVHPLDKKEMLKKTFLAKDDHKESQEAQNIAGGSMMMSEKTDEEDSGREIFLSCSHPLELLEEATLNVLSAQLLDGGIFHEQTGQKLLLNEAISRGIVPSHTAVKLMEKLNMFQGFFDSQTCESLTTEEVINEGLMDEKLLHNVLMADKAISGVLDPRTQTLCSVKDAVTVGLLDKETATRILERQVVTGGIIDLKRGKKVSVTLASTLGLVDVADQPELINLEKASKGRDAEKTVRERLISLQMETTGLIDPDSKAPLTVVQSIDRGLLEREEAVRLLTKQVVDGGIIHHISGMRLSVDNAFRHGLIGEDLAEKLKRVENLNIHQIFNPETKENISLPKAIKLDLITSDLKREIQEVQAFTGNFVDLISGQRLTLAEAKKEGLLTNEAVLSPGMMHGIVDPENCRIVPYSELVKKCKIDIESGQRYLEVIPFSDIKDGVSDKVLTLSQAIQLGKVDFASTLKVLEAQANTGGIIDTATGKRLTLASALEEKLVDENMVRIIASHQVLNGGIVDIFSDQRVTLVEAIEKRLISPELANMIQIDSSEFSDHRAQIEKQEGIEVCALQNEFLGKDMLIACNQTAEMSCNKVEESERLFQVENQSAQEKVKVRVSDGEQAKKSREISLKEFGCKDQRKPRMSSDAKEFISIINPHNLKGKSLGQVSLTHPYSECDFKLKEVARNNMGNDTNEEQEKAVTKIEIISHMKQSTSCLDSEEIRENQGEVILEVQETYCETSGKLPSEQVLQQPMNARVKSKREKREVIVEESIRTCKPAFLSEEKLYQETAIRDEHDSHIKSQPREMTSSEKGKEADTEMGFSITFKIEESSSQVVPQGISVKHLDALTLFSSKQANEGKVNNLSLCLTLKPEENLSREIACGAQSEPFPCMTPRPEGLHYQESDGKAQVTGPSQISKTDKSFQGTTRQETNYQDSWVTSKTKETKHQISSSNECKEKSYQEVSFDPARGLKLEEITVSRPDSKEVRYLEFSDRKDLHHQGSKSDDKLCGTLKSEIATQELTGEKFLEMANPNVAGLEAGSIEDIVTQRGSRVLGSFLPEKLFKGVSQKENTGQQNAIISPTVLETSEEKTVSLTVCSAVKTEKTPQEKLRESPGSEQTPFMTAPEGKGNGGVNPEPFRATQNVFTRQLCLEHDEKLVSYLSLLRNIEMRTKQIQPLELNLAELQDLLCQAKVLERELKDLTTLVSQELECVNQIIISQPQEVPAQLLKALEKDAKNLQKSLSSVSDTWNSRLLHFQNAVEIEKTKVLNQHTQLEGRLQDLRAWVGNKNLILNSKGSNSEIDVDSLNLCLQQYEDLKQPMAERKAQLDALAFDIQFFISEHAQDLSPQQNRQMLRLLNELQRSFQDILEQTAAQVDALQGHLQQMEQEALVKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFFLGNQFGDSQQLRLVRILRSTVMVRVGGGWMALDEFLVKNDPCRVHHPGSKIKRSDSSSSISSQSPIARGRTNIELREKFILPEGASQGMTPFRSRGRRSKPSSRAASPTRSSSSASQSNHSCTSMPSSPATPASGTKTSLQFSRCYDKPWLVNSKAGTPIRDSHSPDLQLPTPEVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 51462 - protein, 121 aa, Homo sapiens; identical to SEQ ID NO: 51455
  Payload ID: 10253
  Gene Symbol: MACF1
  Gene Name: microtubule-actin crosslinking factor 1
  ENSP ID: ENSP00000473615

SEQ ID NO: 51463 - protein, 121 aa, Homo sapiens
  Payload ID: 10254
  Gene Symbol: MAP1LC3A
  Gene Name: microtubule-associated protein 1 light chain 3 alpha
  Uniprot ID: Q9H492
  ENSP ID: ENSP00000353886
MPSDRPFKQRRSFADRCKEVQQIRDQHPSKIPVIIERYKGEKQLPVLDKTKFLVPDHVNMSELVKIIRRRLQLNPTQAFFLLVNQHSMVSVSTPIADIYEQEKDEDGFLYMVYASQETFGF

SEQ ID NO: 51464 - protein, 125 aa, Homo sapiens
  Payload ID: 10254
  Gene Symbol: MAP1LC3A
  Gene Name: microtubule-associated protein 1 light chain 3 alpha
  Uniprot ID: Q9H492
  ENSP ID: ENSP00000363970
MKMRFFSSPCGKAAVDPADRCKEVQQIRDQHPSKIPVIIERYKGEKQLPVLDKTKFLVPDHVNMSELVKIIRRRLQLNPTQAFFLLVNQHSMVSVSTPIADIYEQEKDEDGFLYMVYASQETFGF

SEQ ID NO: 51465 - protein, 121 aa, Homo sapiens; identical to SEQ ID NO: 51463
  Payload ID: 10254
  Gene Symbol: MAP1LC3A
  Gene Name: microtubule-associated protein 1 light chain 3 alpha
  Uniprot ID: Q9H492
  ENSP ID: ENSP00000380821

SEQ ID NO: 51466 - protein, 125 aa, Homo sapiens
  Payload ID: 10255
  Gene Symbol: MAP1LC3B
  Gene Name: microtubule-associated protein 1 light chain 3 beta
  Uniprot ID: Q9GZQ8
  ENSP ID: ENSP00000268607
MPSEKTFKQRRTFEQRVEDVRLIREQHPTKIPVIIERYKGEKQLPVLDKTKFLVPDHVNMSELIKIIRRRLQLNANQAFFLLVNGHSMVSVSTPISEVYESEKDEDGFLYMVYASQETFGMKLSV

SEQ ID NO: 51467 - protein, 68 aa, Homo sapiens
  Payload ID: 10255
  Gene Symbol: MAP1LC3B
  Gene Name: microtubule-associated protein 1 light chain 3 beta
  ENSP ID: ENSP00000454293
MPSEKTFKQRRTFGECRREGGGCGGAGVRAVEGGRAWDAVRGRGRAGRPSGAGGCRPAGPRDAGPGAP

SEQ ID NO: 51468 - protein, 47 aa, Homo sapiens
  Payload ID: 10255
  Gene Symbol: MAP1LC3B
  Gene Name: microtubule-associated protein 1 light chain 3 beta
  ENSP ID: ENSP00000457141
MPSEKTFKQRRTFEQRVEDVRLIREQHPTKIPGGRITVYRKDVRSVQ

SEQ ID NO: 51469 - protein, 75 aa, Homo sapiens
  Payload ID: 10255
  Gene Symbol: MAP1LC3B
  Gene Name: microtubule-associated protein 1 light chain 3 beta
  ENSP ID: ENSP00000457225
MPSEKTFKQRRTFEQRVEDVRLIREQHPTKIPVIIERYKGEKQLPVLDKTKFLVPDHVNMSELIKIIRYSVTFVS

SEQ ID NO: 51470 - protein, 125 aa, Homo sapiens
  Payload ID: 10256
  Gene Symbol: MAP1LC3B2
  Gene Name: microtubule-associated protein 1 light chain 3 beta 2
  Uniprot ID: A6NCE7
  ENSP ID: ENSP00000450524
MPSEKTFKQRRTFEQRVEDVRLIREQHPTKIPVIIERYKGEKQLPVLDKTKFLVPDHVNMSELIKIIRRRLQLNANQAFFLLVNGHSMVSVSTPISEVYESEKDEDGFLYMVCASQETFGMKLSV

SEQ ID NO: 51471 - protein, 147 aa, Homo sapiens
  Payload ID: 10257
  Gene Symbol: MAP1LC3C
  Gene Name: microtubule-associated protein 1 light chain 3 gamma
  Uniprot ID: Q9BXW4
  ENSP ID: ENSP00000349785
MPPPQKIPSVRPFKQRKSLAIRQEEVAGIRAKFPNKIPVVVERYPRETFLPPLDKTKFLVPQELTMTQFLSIIRSRMVLRATEAFYLLVNNKSLVSMSATMAEIYRDYKDEDGFVYMTYASQETFGCLESAAPRDGSSLEDRPCNPL

SEQ ID NO: 51472 - protein, 1047 aa, Homo sapiens
  Payload ID: 10258
  Gene Symbol: MAP10
  Gene Name: microtubule-associated protein 10
  Uniprot ID: Q9P2G4
  ENSP ID: ENSP00000403208
MAHCGQLTNWLCLAWERKESPDFLSIFLRYIDLTPKLHKICSDKTITQKTHCLLPLISSALSSIVLIQGWWQKTAHKYAYKGAKHIEQQNPQSRHRPRPAGALPQISRDSRQRCLLLRFLVRPRGFSFSFAEPAAAFPGATAMAASLSERLFSLELLVDWVRLEARLLPSPAAAVEQEEEEEEKEQGEASSPRGLCPAVAFRLLDFPTLLVYPPDGPGAPAAEPWPGVIRFGRGKSCLFRLQPATLHCRLLRTPLATLLLQLPPGRPTPTPQLLGACDISLATAAHRVVGPAASGCSHRHRGRFPLHNRVGERTGDIALAYRLTDLGSRLLSQLERPLTFTRTGGGAEVSPQTQQERQQLQQPASQPSPKEADKPLGELEIPEAQKDLKEMVKSKAECDNVGSVENGKTNSVVTCSGAGNGRNVSSLNEEVTELDMETNIFCPPPLYYTNLTQEKPPPAQAKITIEPQMNAPEEMDDASPEKKRVNPPAHRSCLKHPSSAAHEHPPMLVNPPHIQNIGATNQTCQTEQNRINTIRQLPLLNALLVELSLLYDQPVTSPAHIHPHLAWLYRTEDKKSPESSAKSTCRSEAKKDKRSVGGCEKSVSLQYKKNQIENYKEDKYSEKSSGALHKRVPKGRLLYGLTNTLRLRLKLTNPDMLVVHEKRELYRKRQSQMLGTKFRIPSSKVKLLSSAEQSQKPQLPEDKYLDSDASFTENSDTSRQISGVFDEPSTSKETKLKYATEKKTVDCSKNRINNVSLEEVVSPANSIIPERLTPTNILGGNVEMKIQSPCVFQQDAVVDRIVDKEIDIRQVKTTDNDILMADISDKRTGKNSCYENISELKYSDDLSSPCYSEDFCTSEDTSRSFKAHDSSSRTENPKHSQYTSKSSDTGVSKKKNSSDRSSILSPPFSAGSPVHSYRKFHISKTQDKSLEEASSISASDLSSTHWTEQKENQIDQNSMHNSEITKRAQDISVKTRSSWKSLEKSQSPQTSQVSSYLPSNVSELNVLDSSTSDHFEEGNDDVGSLNISKQCKDICELVINKLPGYTM

SEQ ID NO: 51473 - protein, 2803 aa, Homo sapiens
  Payload ID: 10259
  Gene Symbol: MAP1A
  Gene Name: microtubule-associated protein 1A
  Uniprot ID: P78559
  ENSP ID: ENSP00000300231
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 51474 - protein, 3041 aa, Homo sapiens
  Payload ID: 10259
  Gene Symbol: MAP1A
  Gene Name: microtubule-associated protein 1A
  ENSP ID: ENSP00000371462
METEAEPARPHGVAMETTPGLGLRSPGAPLAQNPAELLCEAGAAVAAARWDLQKHSLLIVIGDIGTESQLRAVRAHLEQGILSWNIDLSSFDLNQQLRLFITRHLAHFSSEVKGQRTLCHQSEILETIILVNPSADSISSEVHHLLSSSSAYKLLILSGQSLEPGGDLILQSGTYSYENFAQVLHNPEISQLLSNRDPGIQAFLTVSCLGEGDWSHLGLSSSQETLHLRLNPEPTLPTMDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 51475 - protein, 2468 aa, Homo sapiens
  Payload ID: 10260
  Gene Symbol: MAP1B
  Gene Name: microtubule-associated protein 1B
  Uniprot ID: P46821
  ENSP ID: ENSP00000296755
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPIKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 51476 - protein, 569 aa, Homo sapiens
  Payload ID: 10260
  Gene Symbol: MAP1B
  Gene Name: microtubule-associated protein 1B
  ENSP ID: ENSP00000423416
MITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPIKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKE

SEQ ID NO: 51477 - protein, 670 aa, Homo sapiens
  Payload ID: 10260
  Gene Symbol: MAP1B
  Gene Name: microtubule-associated protein 1B
  ENSP ID: ENSP00000423444
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEILKGGHNKCPVNLNFFKIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPIKTETKPSVTEKEVPSKEEPSPVKAEVAEKQATDVKPKAAKEKTVKKETKVKPEDKKEEK

SEQ ID NO: 51478 - protein, 122 aa, Homo sapiens
  Payload ID: 10260
  Gene Symbol: MAP1B
  Gene Name: microtubule-associated protein 1B
  ENSP ID: ENSP00000426312
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVST

SEQ ID NO: 51479 - protein, 103 aa, Homo sapiens
  Payload ID: 10260
  Gene Symbol: MAP1B
  Gene Name: microtubule-associated protein 1B
  ENSP ID: ENSP00000427194
MATVVVEATEPEPSGSIANPAASTSPSLSHRFLDSKFYLLVVVGEIVTEEHLRRAIGNIELGIRSWDTNLIECNLDQELKLFVSRHSARFSPEVPEMKKNIKE

SEQ ID NO: 51480 - protein, 1059 aa, Homo sapiens
  Payload ID: 10261
  Gene Symbol: MAP1S
  Gene Name: microtubule-associated protein 1S
  Uniprot ID: Q66K74
  ENSP ID: ENSP00000325313
MAAVAGSGAAAAPSSLLLVVGSEFGSPGLLTYVLEELERGIRSWDVDPGVCNLDEQLKVFVSRHSATFSSIVKGQRSLHHRGDNLETLVLLNPSDKSLYDELRNLLLDPASHKLLVLAGPCLEETGELLLQTGGFSPHHFLQVLKDREIRDILATTPPPVQPPILTITCPTFGDWAQLAPAVPGLQGALRLQLRLNPPAQLPNSEGLCEFLEYVAESLEPPSPFELLEPPTSGGFLRLGRPCCYIFPGGLGDAAFFAVNGFTVLVNGGSNPKSSFWKLVRHLDRVDAVLVTHPGADSLPGLNSLLRRKLAERSEVAAGGGSWDDRLRRLISPNLGVVFFNACEAASRLARGEDEAELALSLLAQLGITPLPLSRGPVPAKPTVLFEKMGVGRLDMYVLHPPSAGAERTLASVCALLVWHPAGPGEKVVRVLFPGCTPPACLLDGLVRLQHLRFLREPVVTPQDLEGPGRAESKESVGSRDSSKREGLLATHPRPGQERPGVARKEPARAEAPRKTEKEAKTPRELKKDPKPSVSRTQPREVRRAASSVPNLKKTNAQAAPKPRKAPSTSHSGFPPVANGPRSPPSLRCGEASPPSAACGSPASQLVATPSLELGPIPAGEEKALELPLAASSIPRPRTPSPESHRSPAEGSERLSLSPLRGGEAGPDASPTVTTPTVTTPSLPAEVGSPHSTEVDESLSVSFEQVLPPSAPTSEAGLSLPLRGPRARRSASPHDVDLCLVSPCEFEHRKAVPMAPAPASPGSSNDSSARSQERAGGLGAEETPPTSVSESLPTLSDSDPVPLAPGAADSDEDTEGFGVPRHDPLPDPLKVPPPLPDPSSICMVDPEMLPPKTARQTENVSRTRKPLARPNSRAAAPKATPVAAAKTKGLAGGDRASRPLSARSEPSEKGGRAPLSRKSSTPKTATRGPSGSASSRPGVSATPPKSPVYLDLAYLPSGSSAHLVDEEFFQRVRALCYVISGQDQRKEEGMRAVLDALLASKQHWDRDLQVTLIPTFDSVAMHTWYAETHARHQALGITVLGSNSMVSMQDDAFPACKVEF

SEQ ID NO: 51481 - protein, 1033 aa, Homo sapiens
  Payload ID: 10261
  Gene Symbol: MAP1S
  Gene Name: microtubule-associated protein 1S
  Uniprot ID: Q66K74
  ENSP ID: ENSP00000439243
MAGMIDRFSPANTGIRSWDVDPGVCNLDEQLKVFVSRHSATFSSIVKGQRSLHHRGDNLETLVLLNPSDKSLYDELRNLLLDPASHKLLVLAGPCLEETGELLLQTGGFSPHHFLQVLKDREIRDILATTPPPVQPPILTITCPTFGDWAQLAPAVPGLQGALRLQLRLNPPAQLPNSEGLCEFLEYVAESLEPPSPFELLEPPTSGGFLRLGRPCCYIFPGGLGDAAFFAVNGFTVLVNGGSNPKSSFWKLVRHLDRVDAVLVTHPGADSLPGLNSLLRRKLAERSEVAAGGGSWDDRLRRLISPNLGVVFFNACEAASRLARGEDEAELALSLLAQLGITPLPLSRGPVPAKPTVLFEKMGVGRLDMYVLHPPSAGAERTLASVCALLVWHPAGPGEKVVRVLFPGCTPPACLLDGLVRLQHLRFLREPVVTPQDLEGPGRAESKESVGSRDSSKREGLLATHPRPGQERPGVARKEPARAEAPRKTEKEAKTPRELKKDPKPSVSRTQPREVRRAASSVPNLKKTNAQAAPKPRKAPSTSHSGFPPVANGPRSPPSLRCGEASPPSAACGSPASQLVATPSLELGPIPAGEEKALELPLAASSIPRPRTPSPESHRSPAEGSERLSLSPLRGGEAGPDASPTVTTPTVTTPSLPAEVGSPHSTEVDESLSVSFEQVLPPSAPTSEAGLSLPLRGPRARRSASPHDVDLCLVSPCEFEHRKAVPMAPAPASPGSSNDSSARSQERAGGLGAEETPPTSVSESLPTLSDSDPVPLAPGAADSDEDTEGFGVPRHDPLPDPLKVPPPLPDPSSICMVDPEMLPPKTARQTENVSRTRKPLARPNSRAAAPKATPVAAAKTKGLAGGDRASRPLSARSEPSEKGGRAPLSRKSSTPKTATRGPSGSASSRPGVSATPPKSPVYLDLAYLPSGSSAHLVDEEFFQRVRALCYVISGQDQRKEEGMRAVLDALLASKQHWDRDLQVTLIPTFDSVAMHTWYAETHARHQALGITVLGSNSMVSMQDDAFPACKVEF

SEQ ID NO: 51482 - protein, 81 aa, Homo sapiens
  Payload ID: 10261
  Gene Symbol: MAP1S
  Gene Name: microtubule-associated protein 1S
  ENSP ID: ENSP00000468878
MRQAFGQWTQGYGRDDRQVQPCQHRSGLGMDPKRVRRWNKLPAHMVSGRMRRLQGTERTVSLSTRSSRSLCPDTLPPSPAL

SEQ ID NO: 51483 - protein, 82 aa, Homo sapiens
  Payload ID: 10261
  Gene Symbol: MAP1S
  Gene Name: microtubule-associated protein 1S
  ENSP ID: ENSP00000469123
MAAVAGSGAAAAPSSLLLVVGSEFGSPGLLTYVLEELERAQGLCVPTLCHLLQHCERPAEPAPPWRQPGDPGPPEPIRQVPV

SEQ ID NO: 51484 - protein, 79 aa, Homo sapiens
  Payload ID: 10261
  Gene Symbol: MAP1S
  Gene Name: microtubule-associated protein 1S
  ENSP ID: ENSP00000469232
MRQAFGQWTQGYGRDDRQVQPCQHRSGLGMDPKRVRRWNKLPAHMVSGRMRRLQGTERTVSLSTRRHPVLGCRSWRLQP

SEQ ID NO: 51485 - protein, 185 aa, Homo sapiens
  Payload ID: 10261
  Gene Symbol: MAP1S
  Gene Name: microtubule-associated protein 1S
  ENSP ID: ENSP00000469321
MAAVAGSGAAAAPSSLLLVVGSEFGSPGLLTYVLEELERGIRSWDVDPGVCNLDEQLKVFVSRHSATFSSIVKGQRSLHHRGDNLETLVLLNPSDKSLYDELRNLLLDPASHKLLVLAGHPCPESPQPPRLPLEARRGQPAAGPGCQPPHPSPRSTWTWPTCPAGAAPTWWMRSSSSACARSATS

SEQ ID NO: 51486 - protein, 189 aa, Homo sapiens
  Payload ID: 10261
  Gene Symbol: MAP1S
  Gene Name: microtubule-associated protein 1S
  ENSP ID: ENSP00000469571
MKKKMNEWSLGRGGSQADTQESANPFNARIPCSPRPQRACIRSWDVDPGVCNLDEQLKVFVSRHSATFSSIVKGQRSLHHRGDNLETLVLLNPSDKSLYDELRNLLLDPASHKLLVLAGPCLEETGELLLQTGGFSPHHFLQVLKDREIRDILATTPPPVQPPILTITCPTFGDWAQLAPAVPGLQGAL

SEQ ID NO: 51487 - protein, 67 aa, Homo sapiens
  Payload ID: 10261
  Gene Symbol: MAP1S
  Gene Name: microtubule-associated protein 1S
  ENSP ID: ENSP00000469854
MRQAFGQWTQGYGRDDRQVQPCQHRSGLGMDPKRVRRWNKLPAHMVSGRMRRLQGTERTVSLSTRRC

SEQ ID NO: 51488 - protein, 93 aa, Homo sapiens
  Payload ID: 10261
  Gene Symbol: MAP1S
  Gene Name: microtubule-associated protein 1S
  ENSP ID: ENSP00000470306
MAAVAGSGAAAAPSSLLLVVGSEFGSPGLLTYVLEELERGIRSWDVDPGVCNLDEQLKVFVSRHSATFSSIVKDEEIGIEGGRGREISEEGVF

SEQ ID NO: 51489 - protein, 188 aa, Homo sapiens
  Payload ID: 10261
  Gene Symbol: MAP1S
  Gene Name: microtubule-associated protein 1S
  ENSP ID: ENSP00000471903
MAAVAGSGAAAAPSSLLLVVGSEFGSPGLLTYVLEELERGQRSLHHRGDNLETLVLLNPSDKSLYDELRNLLLDPASHKLLVLAGPCLEETGELLLQTGGFSPHHFLQVLKDREIRDILATTPPPVQPPILTITCPTFGDWAQLAPAVPGLQGALRLQLRLNPPAQLPNSEGLCEFLEYVAESLEPPS

SEQ ID NO: 51490 - protein, 120 aa, Homo sapiens
  Payload ID: 10261
  Gene Symbol: MAP1S
  Gene Name: microtubule-associated protein 1S
  ENSP ID: ENSP00000471994
RWAPRTRPRWTSPCRCPLSSAHLVDEEFFQRVRALCYVISGQDQRKEEGMRAVLDALLASKQHWDRDLQVTLIPTFDSVAMHTWYAETHARHQALGITVLGSNSMVSMQDDAFPACKVEF

SEQ ID NO: 51491 - protein, 559 aa, Homo sapiens
  Payload ID: 10262
  Gene Symbol: MAP2
  Gene Name: microtubule-associated protein 2
  Uniprot ID: P11137
  ENSP ID: ENSP00000199940
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSNSTLSKIPALQGSTKSPRYSSACPSTTKRATFSDSLLIQPTSAGSTDRLPYSKSGNKDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 51492 - protein, 1827 aa, Homo sapiens
  Payload ID: 10262
  Gene Symbol: MAP2
  Gene Name: microtubule-associated protein 2
  Uniprot ID: P11137
  ENSP ID: ENSP00000353508
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKEKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 51493 - protein, 471 aa, Homo sapiens
  Payload ID: 10262
  Gene Symbol: MAP2
  Gene Name: microtubule-associated protein 2
  Uniprot ID: P11137
  ENSP ID: ENSP00000355290
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 51494 - protein, 106 aa, Homo sapiens
  Payload ID: 10262
  Gene Symbol: MAP2
  Gene Name: microtubule-associated protein 2
  ENSP ID: ENSP00000376031
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVL

SEQ ID NO: 51495 - protein, 471 aa, Homo sapiens; identical to SEQ ID NO: 51493
  Payload ID: 10262
  Gene Symbol: MAP2
  Gene Name: microtubule-associated protein 2
  Uniprot ID: P11137
  ENSP ID: ENSP00000376032

SEQ ID NO: 51496 - protein, 208 aa, Homo sapiens
  Payload ID: 10262
  Gene Symbol: MAP2
  Gene Name: microtubule-associated protein 2
  ENSP ID: ENSP00000388824
INGELTSADRETAEEVSARIVQVVTAEAVAVLKGEQEKEAQHKDQTAALPLAAEETANLPPSPPPSPASEQTVTVEEAAGGESALAPSVFKQAKDKVSGVHVQACYKGILRDAENSTLSKIPALQGSTKSPRYSSACPSTTKRATFSDSLLIQPTSAGSTDRLPYSKSGNKDGVTKSPEKRSSLPRPSSILPPRRGVSGDRDENSFSL

SEQ ID NO: 51497 - protein, 1823 aa, Homo sapiens
  Payload ID: 10262
  Gene Symbol: MAP2
  Gene Name: microtubule-associated protein 2
  Uniprot ID: P11137
  ENSP ID: ENSP00000392164
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKEKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 51498 - protein, 567 aa, Homo sapiens
  Payload ID: 10262
  Gene Symbol: MAP2
  Gene Name: microtubule-associated protein 2
  ENSP ID: ENSP00000409969
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEEEETLESRMAEEEKPAALPEKECGAAKSSDQPKGLSKGQMESSAEAQIVPEESAPAGAPHEKSVKEVKEVSPEVKTPSSAGEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQK

SEQ ID NO: 51499 - protein, 463 aa, Homo sapiens
  Payload ID: 10263
  Gene Symbol: MAP4
  Gene Name: microtubule-associated protein 4
  ENSP ID: ENSP00000334770
ICEEPVAKKREELAHFSNSSSNSGKKELGTAGLYLHSKLEQIPEGSSKEKGQEDFSETRIDSCSQVCQRGEKQPGQTALAGKKEIEVTATQSTPSFLFEKPPRDGIARPEEGRPVVSGTGNDITTPPNKELPPSPEKKTKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKIETYRLTFRANARARTDHGADIVSRPPHFPGGPNSGSRVLGPLSRAVH

SEQ ID NO: 51500 - protein, 1152 aa, Homo sapiens
  Payload ID: 10263
  Gene Symbol: MAP4
  Gene Name: microtubule-associated protein 4
  Uniprot ID: P27816
  ENSP ID: ENSP00000353375
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 51501 - protein, 760 aa, Homo sapiens
  Payload ID: 10263
  Gene Symbol: MAP4
  Gene Name: microtubule-associated protein 4
  ENSP ID: ENSP00000373242
KTDAANRYTAVADKPSKRSNDGKSKKVKNSSPEKHILENKIDATKIHVPMETTGDQGIEGMAYMDENRNITFTCPRTPSELINKSSPLEVLESAACEKLPTPTPQVVKEGDSFPDTLAKNGQEIAPAQISKSLMVDNYTKDGVPGQERPKGPSAVVPSTSTGGVALPITTAIETVNIHGDHSLKNKAELADSMKNEAGIDEGHVIGESESVHSGASKHSVEKVTELAKGHLLPGVPVEDQSLPGEARALEGYADRGNFPAHPVNEEKETKEGSVAVQIPDLLEDKAQKLSFCEDQNAQDRNSKGSDSLNKKVDLTLLSPKSENDKLKEISLACKITELESVSLPTPEIQSDFLHSKVEAPPSEVADTLVIMTASKGVRLPEPKDKILETPQKMTEKSESKTPGEGKKEDKSRMAEPMKGYMRPTKSRGLTPLLPKSTIQEQERHKQLKSAGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKAKVEKKTEAAATTRKPESNAVTKTAGPIASAQKQPAGK

SEQ ID NO: 51502 - protein, 1135 aa, Homo sapiens
  Payload ID: 10263
  Gene Symbol: MAP4
  Gene Name: microtubule-associated protein 4
  Uniprot ID: P27816
  ENSP ID: ENSP00000379083
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKIETYRLTFRANARARTDHGADIVSRPPHFPGGPNSGSRVLGPLSRAVH

SEQ ID NO: 51503 - protein, 99 aa, Homo sapiens
  Payload ID: 10263
  Gene Symbol: MAP4
  Gene Name: microtubule-associated protein 4
  Uniprot ID: P27816
  ENSP ID: ENSP00000397414
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTEA

SEQ ID NO: 51504 - protein, 99 aa, Homo sapiens; identical to SEQ ID NO: 51503
  Payload ID: 10263
  Gene Symbol: MAP4
  Gene Name: microtubule-associated protein 4
  Uniprot ID: P27816
  ENSP ID: ENSP00000402767

SEQ ID NO: 51505 - protein, 2297 aa, Homo sapiens
  Payload ID: 10263
  Gene Symbol: MAP4
  Gene Name: microtubule-associated protein 4
  ENSP ID: ENSP00000407602
MADLSLADALTEPSPDIEGEIKRDFIATLEAEAFDDVVGETVGKTDYIPLLDVDEKTGNSESKKKPCSETSQIEDLPLPPHPASLSFHLPLDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSANFMYCGTPPTQAKQVCRPSDRRSTRPKPARVPPELLGGSPPWKTLDHRLGHCSLSESGWVSGSSSCGGPGNQRKSIHVDSLEPQRDLGREAWDIESTPIMMKKKKKKPKQKRYSQPRAGGPSDDDNADKPKGHPFAADTQKSGVLPSQPTTMGTEYGLVSGENLKRECLVNSSAARLVAENFVSESLRIPLYPSEEAPKTAISSQSKLRVEEESKSNKSVLQNQDKKLLKQHEYKPQPAPHLKTPVDKSQSVGPLNLKGPLAEVSAYNVETPLDIRLKEGCSPFLDQEVMGVVSKPTAAKEIPNLVPTLIASNPLECNLKEGNNESKMTKLQNVKLKEFPEGAEEDKELKKEAFPNERQEISIFTSEQLQGQVLVQVPGVENEPFKRMAGDGKSRKGRGSSGKMRTDSGKVKAKSELPFLLDSQKDGRAVLIPSEPVSKTEGMTTQDKSEELGLNSSKQPGTKADLTEAVVMGEPKEMTQPKVAGTMQALIPLESGSGMTQTSGVSTETGDVVKDMGVNNQSKEGRCPWKDHEAAPWISEKPKKRGNEGKSKKFKNNYSTQPARMERKEEILNPPFEGKDGDTGSIPHKSKEIGFTFPKMHDSSFSHTPDTPTVEAVDRKGGNFQVNFVELGTLGENKISTVKASTVTEPPAKVTDVSCQEQIQGAGFVPSVVSEENKTDAANRYTAVADKPSKRSNDGKSKKVKNSSPEKHILENKIDATKIHVPMETTGDQGIEGMAYMDENRNITFTCPRTPSELINKSSPLEVLESAACEKLPTPTPQVVKEGDSFPDTLAKNGQEIAPAQISKSLMVDNYTKDGVPGQERPKGPSAVVPSTSTGGVALPITTAIETVNIHGDHSLKNKAELADSMKNEAGIDEGHVIGESESVHSGASKHSVEKVTELAKGHLLPGVPVEDQSLPGEARALEGYADRGNFPAHPVNEEKETKEGSVAVQIPDLLEDKAQKLSFCEDQNAQDRNSKGSDSLNKKVDLTLLSPKSENDKLKEISLACKITELESVSLPTPEIQSDFLHSKVEAPPSEVADTLVIMTASKGVRLPEPKDKILETPQKMTEKSESKTPGEGKKEDKSRMAEPMKGYMRPTKSRGLTPLLPKSTIQEQERHKQLKSAGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 51506 - protein, 828 aa, Homo sapiens
  Payload ID: 10263
  Gene Symbol: MAP4
  Gene Name: microtubule-associated protein 4
  ENSP ID: ENSP00000409731
MSLSDKQTASLTAAYGQLSKGKPAECRMDSPKEISQAGFEWQRTEGKLNEIGLNVSMDGQPKDGLVKNASFLEQNKLCFFEGKLDKELSIEMQDKDCQEASGHLESRYVISETCHPLEGNSVHQKTSEFHLGLIEGPDKNKTIPVQGKVAGKNGLETKSQSDLDFPGAADIPTRYVKEQETSVWNPSFHPVAQGSLGSREATPGEMENSITPGCPVIGVVNDNSEQLKCESPLLVSLAHPAPIIEHSPTTIPPITMVFTQEHLNASCHIRDHDKELEKLSSTEEAVLNQAPQQKKAVRRALSECSHLSVPPAVNLADKYPELPAREEPSSGLLPPPSSPMPSPTPGKLGAPAMKRSMTVGEEQTASYKLSPGKLPILSTKEIPPFICEEPVAKKREELAHFSNSSSNSGKKELGTAGLYLHSKLEQIPEGSSKEKGQEDFSETRIDSCSQVCQRGEKQPGQTALAGKKEIEVTATQSTPSFLFEKPPRDGIARPEEGRPVVSGTGNDITTPPNKELPPSPEKKTKPIADAKAPEKRASPSKPASAPASRSGSKSTQTVAKTTTAAAVASTGPSSRSPSTLLPKKPTADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKIETYRLTFRANARARTDHGADIVSRPPHFPGGPNSGSRVLGPLSRAVH

SEQ ID NO: 51507 - protein, 283 aa, Homo sapiens
  Payload ID: 10263
  Gene Symbol: MAP4
  Gene Name: microtubule-associated protein 4
  ENSP ID: ENSP00000415689
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVR

SEQ ID NO: 51508 - protein, 493 aa, Homo sapiens
  Payload ID: 10263
  Gene Symbol: MAP4
  Gene Name: microtubule-associated protein 4
  ENSP ID: ENSP00000416743
  MOD_RES (1)..(1): Any amino acid
XKGVRLPEPKDKILETPQKMTEKSESKTPGEGKKEDKSRMAEPMKGYMRPTKSRGLTPLLPKSTIQEQERHKQLKSAGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETN

SEQ ID NO: 51509 - protein, 76 aa, Homo sapiens
  Payload ID: 10263
  Gene Symbol: MAP4
  Gene Name: microtubule-associated protein 4
  ENSP ID: ENSP00000487698
MADLSLADALTEPSPDIEGEIKRDFIATLEAEAFDDVVGETVGKTDYIPLLDVDEKTGNSESKKKPCSETSQIEDT

SEQ ID NO: 51510 - protein, 140 aa, Homo sapiens
  Payload ID: 10263
  Gene Symbol: MAP4
  Gene Name: microtubule-associated protein 4
  ENSP ID: ENSP00000487797
MADLSLADALTEPSPDIEGEIKRDFIATLEAEAFDDVVGETVGKTDYIPLLDVDEKTGNSESKKKPCSETSQIEDLPLPPHPASLSFHLPLDTPSSKPTLLANGGHGVEGSDTTGSPTEFLEEKMAYQEYPNSQNWPEDT

SEQ ID NO: 51511 - protein, 813 aa, Homo sapiens
  Payload ID: 10264
  Gene Symbol: MAP6
  Gene Name: microtubule-associated protein 6
  Uniprot ID: Q96JE9
  ENSP ID: ENSP00000307093
MAWPCITRACCIARFWNQLDKADIAVPLVFTKYSEATEHPGAPPQPPPPQQQAQPALAPPSARAVAIETQPAQGELDAVARATGPAPGPTGEREPAAGPGRSGPGPGLGSGSTSGPADSVMRQDYRAWKVQRPEPSCRPRSEYQPSDAPFERETQYQKDFRAWPLPRRGDHPWIPKPVQISAASQASAPILGAPKRRPQSQERWPVQAAAEAREQEAAPGGAGGLAAGKASGADERDTRRKAGPAWIVRRAEGLGHEQTPLPAAQAQVQATGPEAGRGRAAADALNRQIREEVASAVSSSYRNEFRAWTDIKPVKPIKAKPQYKPPDDKMVHETSYSAQFKGEASKPTTADNKVIDRRRIRSLYSEPFKEPPKVEKPSVQSSKPKKTSASHKPTRKAKDKQAVSGQAAKKKSAEGPSTTKPDDKEQSKEMNNKLAEAKESLAQPVSDSSKTQGPVATEPDKDQGSVVPGLLKGQGPMVQEPLKKQGSVVPGPPKDLGPMIPLPVKDQDHTVPEPLKNESPVISAPVKDQGPSVPVPPKNQSPMVPAKVKDQGSVVPESLKDQGPRIPEPVKNQAPMVPAPVKDEGPMVSASVKDQGPMVSAPVKDQGPIVPAPVKGEGPIVPAPVKDEGPMVSAPIKDQDPMVPEHPKDESAMATAPIKNQGSMVSEPVKNQGLVVSGPVKDQDVVVPEHAKVHDSAVVAPVKNQGPVVPESVKNQDPILPVLVKDQGPTVLQPPKNQGRIVPEPLKNQVPIVPVPLKDQDPLVPVPAKDQGPAVPEPLKTQGPRDPQLPTVSPLPRVMIPTAPHTEYIESSP

SEQ ID NO: 51512 - protein, 439 aa, Homo sapiens
  Payload ID: 10264
  Gene Symbol: MAP6
  Gene Name: microtubule-associated protein 6
  Uniprot ID: Q96JE9
  ENSP ID: ENSP00000415108
MAWPCITRACCIARFWNQLDKADIAVPLVFTKYSEATEHPGAPPQPPPPQQQAQPALAPPSARAVAIETQPAQGELDAVARATGPAPGPTGEREPAAGPGRSGPGPGLGSGSTSGPADSVMRQDYRAWKVQRPEPSCRPRSEYQPSDAPFERETQYQKDFRAWPLPRRGDHPWIPKPVQISAASQASAPILGAPKRRPQSQERWPVQAAAEAREQEAAPGGAGGLAAGKASGADERDTRRKAGPAWIVRRAEGLGHEQTPLPAAQAQVQATGPEAGRGRAAADALNRQIREEVASAVSSSYRNEFRAWTDIKPVKPIKAKPQYKPPDDKMVHETSYSAQFKGEASKPTTADNKVIDRRRIRSLYSEPFKEPPKVEKPSVQSSKPKKTSASHKPTRKAKDKQAVSGQAAKKKSAEGPSTTKPDDKEQSKEMNNKLAEAKE

SEQ ID NO: 51513 - protein, 484 aa, Homo sapiens
  Payload ID: 10264
  Gene Symbol: MAP6
  Gene Name: microtubule-associated protein 6
  Uniprot ID: Q96JE9
  ENSP ID: ENSP00000434278
MVHETSYSAQFKGEASKPTTADNKVIDRRRIRSLYSEPFKEPPKVEKPSVQSSKPKKTSASHKPTRKAKDKQAVSGQAAKKKSAEGPSTTKPDDKEQSKEMNNKLAEAKESLAQPVSDSSKTQGPVATEPDKDQGSVVPGLLKGQGPMVQEPLKKQGSVVPGPPKDLGPMIPLPVKDQDHTVPEPLKNESPVISAPVKDQGPSVPVPPKNQSPMVPAKVKDQGSVVPESLKDQGPRIPEPVKNQAPMVPAPVKDEGPMVSASVKDQGPMVSAPVKDQGPIVPAPVKGEGPIVPAPVKDEGPMVSAPIKDQDPMVPEHPKDESAMATAPIKNQGSMVSEPVKNQGLVVSGPVKDQDVVVPEHAKVHDSAVVAPVKNQGPVVPESVKNQDPILPVLVKDQGPTVLQPPKNQGRIVPEPLKNQVPIVPVPLKDQDPLVPVPAKDQGPAVPEPLKTQGPRDPQLPTVSPLPRVMIPTAPHTEYIESSP

SEQ ID NO: 51514 - protein, 749 aa, Homo sapiens
  Payload ID: 10265
  Gene Symbol: MAP7
  Gene Name: microtubule-associated protein 7
  Uniprot ID: Q14244
  ENSP ID: ENSP00000346581
MAELGAGGDGHRGGDGAVRSETAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 51515 - protein, 734 aa, Homo sapiens
  Payload ID: 10265
  Gene Symbol: MAP7
  Gene Name: microtubule-associated protein 7
  Uniprot ID: Q14244
  ENSP ID: ENSP00000400790
MPGSATALRHERLKKTNARPIPLGLFTINEEDEQQKNGNSRRPKAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSAARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 51516 - protein, 771 aa, Homo sapiens
  Payload ID: 10265
  Gene Symbol: MAP7
  Gene Name: microtubule-associated protein 7
  Uniprot ID: Q14244
  ENSP ID: ENSP00000414712
MPGSATALRHERLKKTNARPIPLGLFTINEEDEQQKNGNSRRPKAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 51517 - protein, 603 aa, Homo sapiens
  Payload ID: 10265
  Gene Symbol: MAP7
  Gene Name: microtubule-associated protein 7
  Uniprot ID: Q14244
  ENSP ID: ENSP00000414879
MERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 51518 - protein, 734 aa, Homo sapiens
  Payload ID: 10265
  Gene Symbol: MAP7
  Gene Name: microtubule-associated protein 7
  Uniprot ID: Q14244
  ENSP ID: ENSP00000445737
MEDTKLYSPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 51519 - protein, 779 aa, Homo sapiens
  Payload ID: 10265
  Gene Symbol: MAP7
  Gene Name: microtubule-associated protein 7
  ENSP ID: ENSP00000482335
MPGSATALRHERLKKTNARPIPLGLFTINEEDEQQKNGNSRRPKAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAVIPICPRSASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 51520 - protein, 712 aa, Homo sapiens
  Payload ID: 10265
  Gene Symbol: MAP7
  Gene Name: microtubule-associated protein 7
  Uniprot ID: Q14244
  ENSP ID: ENSP00000482356
MAELGAGGDGHRGGDGAVRSETAPDSYKVQDKKNASSRPASAISGQNNNHSGNKPDPPPVLRVDDRQRLARERREEREKQLAAREIVWLEREERARQHYEKHLEERKKRLEEQRQKEERRRAAVEEKRRQRLEEDKERHEAVVRRTMERSQKPKQKHNRWSWGGSLHGSPSIHSAARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 51521 - protein, 603 aa, Homo sapiens; identical to SEQ ID NO: 51517
  Payload ID: 10265
  Gene Symbol: MAP7
  Gene Name: microtubule-associated protein 7
  Uniprot ID: Q14244
  ENSP ID: ENSP00000482998

SEQ ID NO: 51522 - protein, 655 aa, Homo sapiens
  Payload ID: 10265
  Gene Symbol: MAP7
  Gene Name: microtubule-associated protein 7
  Uniprot ID: Q14244
  ENSP ID: ENSP00000483511
MAELGAGGDGHRGGDGAVRSETAPDSYKVQDKKNASSRPASAISGQNNNHSGNKPDPPPVLRVDDRQRLARERREEREKQLDPDRRSVSTMNLSKYVDPVISKRLSSSSATLLNSPDRARRLQLSPWESSVVNRLLTPTHSFLARSKSTAALSGEAASCSPIIMPYKAAHSRNSMDRPKLFVTPPEGSSRRRIIHGTASYKKERERENVLFLTSGTRRAVSPSNPKARQPARSRLWLPSKSLPHLPGTPRPTSSLPPGSVKAAPAQVRPPSPGNIRPVKREVKVEPEKKDPEKEPQKVANEPSLKGRAPLVKVEEATVEERTPAEPEVGPAAPAMAPAPASAPAPASAPAPAPVPTPAMVSAPSSTVNASASVKTSAGTTDPEEATRLLAEKRRLAREQREKEERERREQEELERQKREELAQRVAEERTTRREEESRRLEAEQAREKEEQLQRQAEERALREREEAERAQRQKEEEARVREEAERVRQEREKHFQREEQERLERKKRLEEIMKRTRRTEATDKKTSDQRNGDIAKGALTGGTEVSALPCTTNAPGNGKPVGSPHVVTSHQSKVTVESTPDLEKQPNENGVSVQNENFEEIINLPIGSKPSRLDVTNSESPEIPLNPILAFDDEGTLGPLPQVDGVQTQQTAEVI

SEQ ID NO: 51523 - protein, 647 aa, Homo sapiens
  Payload ID: 10266
  Gene Symbol: MAP9
  Gene Name: microtubule-associated protein 9
  Uniprot ID: Q49MG5
  ENSP ID: ENSP00000310593
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSAENNSLDTDDHFKPSPRPRSMLKKKSHMEEKDGLEDKETALSEELELHSAPSSLPTPNGIQLEAEKKAFSENLDPEDSCLTSLASSSLKQILGDSFSPGSEGNASGKDPNEEITENHNSLKSDENKENSFSADHVTTAVEKSKESQVTADDLEEEKAKAELIMDDDRTVDPLLSKSQSILISTSATASSKKTIEDRNIKNKKSTNNRASSASARLMTSEFLKKSSSKRRTPSTTTSSHYLGTLKVLDQKPSQKQSIEPDRADNIRAAVYQEWLEKKNVYLHEMHRIKRIESENLRIQNEQKKAAKREEALASFEAWKAMKEKEAKKIAAKKRLEEKNKKKTEEENAARKGEALQAFEKWKEKKMEYLKEKNRKEREYERAKKQKEEETVAEKKKDNLTAVEKWNEKKEAFFKQKEKEKINEKRKEELKRAEKKDKDKQAINEYEKWLENKEKQERIERKQKKRHSFLESEALPPWSPPSRTVFAKVF

SEQ ID NO: 51524 - protein, 190 aa, Homo sapiens
  Payload ID: 10266
  Gene Symbol: MAP9
  Gene Name: microtubule-associated protein 9
  ENSP ID: ENSP00000368550
MNDFHISDDEEKNPSKLLFLKTNKSNGNITKDEPVCAIKNEEEMAPDGCEDIVVKSFSESQNKDEEFEKDKIKMKPKPRILSIKSTSSENNSLDTDDHFKPSPRPRSMLKKKSHMEEKDGLEDKETALSEELELHSAPSSLPTPNGIQLEAEKKAFSENLDPEVSTTTKLLNCVLEFMLFYLIMKKRRRE

SEQ ID NO: 51525 - protein, 488 aa, Homo sapiens
  Payload ID: 10266
  Gene Symbol: MAP9
  Gene Name: microtubule-associated protein 9
  ENSP ID: ENSP00000394048
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSENNSLDTDDHFKPSPRPRSMLKKKSHMEEKDGLEDKETALSEELELHSAPSSLPTPNGIQLEAEKKAFSENLDPEDSCLTSLASSSLKQILGDSFSPGSEGNASGKDPNEEITENHNSLKSDENKENSFSADHVTTAVEKSKESQVTADDLEEEKAKAELIMDDDRTVDPLLSKSQSILISTSATASSKKTIEDRNIKNKKSTNNRASSASARLMTSEFLKKSSSKRRTPSTTTSSHYLGTLKVLDQKPSQKQSIEPDRADNIRAAVYQEWLEKKNVYLHEMHRIKRIESENLRIQNEQKKAAKREEALASFEAWKAMKEKEAKKIAA

SEQ ID NO: 51526 - protein, 31 aa, Homo sapiens
  Payload ID: 10266
  Gene Symbol: MAP9
  Gene Name: microtubule-associated protein 9
  ENSP ID: ENSP00000401509
MSDEVFSTTLAYTKSPKVTKRTTFQDELIRA

SEQ ID NO: 51527 - protein, 376 aa, Homo sapiens
  Payload ID: 10266
  Gene Symbol: MAP9
  Gene Name: microtubule-associated protein 9
  ENSP ID: ENSP00000413553
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSAENNSLDTDDHFKPSPRPRSMLKKKSHMEEKDGLEDKETALSEELELHSAPSSLPTPNGIQLEAEKKAFSENLDPEDSCLTSLASSSLKQILGDSFSPGSEGNASGKDPNEEITENHNSLKSDENKENSFSADHVTTAVEKSKESQVTADDLEEEKAKAELIMDDDRTVDPLLSKSQSILISTSATASSKKTIEDRNIKNKKSTNNRASSASARSG

SEQ ID NO: 51528 - protein, 33 aa, Homo sapiens
  Payload ID: 10266
  Gene Symbol: MAP9
  Gene Name: microtubule-associated protein 9
  ENSP ID: ENSP00000422989
  MOD_RES (1)..(1): Any amino acid
XKINEKRKEELKRAEKKDKDKQAINEYEKWLIE

SEQ ID NO: 51529 - protein, 623 aa, Homo sapiens
  Payload ID: 10266
  Gene Symbol: MAP9
  Gene Name: microtubule-associated protein 9
  ENSP ID: ENSP00000427402
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSAENNSLDTDDHFKPSPRPRSMLKKKSHMEEKDGLEDKETALSEELELHSAPSSLPTPNGIQLEAEKKAFSENLDPEDSCLTSLASSSLKQILGDSFSPGSEGNASGKADHVTTAVEKSKESQVTADDLEEEKAKAELIMDDDRTVDPLLSKSQSILISTSATASSKKTIEDRNIKNKKSTNNRASSASARLMTSEFLKKSSSKRRTPSTTTSSHYLGTLKVLDQKPSQKQSIEPDRADNIRAAVYQEWLEKKNVYLHEMHRIKRIESENLRIQNEQKKAAKREEALASFEAWKAMKEKEAKKIAAKKRLEEKNKKKTEEENAARKGEALQAFEKWKEKKMEYLKEKNRKEREYERAKKQKEEETVAEKKKDNLTAVEKWNEKKEAFFKQKEKEKINEKRKEELKRAEKKDKDKQAINEYEKWLENKEKQERIERKQKKRHSFLESEALPPWSPPSRTVFAKVF

SEQ ID NO: 51530 - protein, 758 aa, Homo sapiens
  Payload ID: 10267
  Gene Symbol: MAPT
  Gene Name: microtubule-associated protein tau
  Uniprot ID: P10636
  ENSP ID: ENSP00000262410
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKTSTRSSAKTLKNRPCLSPKHPTPGSSDPLIQPSSPAVCPEPPSSPKYVSSVTSRTGSSGAKEMKLKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51531 - protein, 441 aa, Homo sapiens
  Payload ID: 10267
  Gene Symbol: MAPT
  Gene Name: microtubule-associated protein tau
  Uniprot ID: P10636
  ENSP ID: ENSP00000303214
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51532 - protein, 352 aa, Homo sapiens
  Payload ID: 10267
  Gene Symbol: MAPT
  Gene Name: microtubule-associated protein tau
  Uniprot ID: P10636
  ENSP ID: ENSP00000334886
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51533 - protein, 412 aa, Homo sapiens
  Payload ID: 10267
  Gene Symbol: MAPT
  Gene Name: microtubule-associated protein tau
  Uniprot ID: P10636
  ENSP ID: ENSP00000340438
MAEPRQEFEVMEDHAGTYGLGDRKDQGGYTMHQDQEGDTDAGLKESPLQTPTEDGSEEPGSETSDAKSTPTAEAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51534 - protein, 776 aa, Homo sapiens
  Payload ID: 10267
  Gene Symbol: MAPT
  Gene Name: microtubule-associated protein tau
  Uniprot ID: P10636
  ENSP ID: ENSP00000340820
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKTSTRSSAKTLKNRPCLSPKHPTPGSSDPLIQPSSPAVCPEPPSSPKYVSSVTSRTGSSGAKEMKLKGADGKTKIATPRGAAPPGQKGQANATRIPAKTPPAPKTPPSSATKQVQRRPPPAGPRSERGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51535 - protein, 410 aa, Homo sapiens
  Payload ID: 10267
  Gene Symbol: MAPT
  Gene Name: microtubule-associated protein tau
  Uniprot ID: P10636
  ENSP ID: ENSP00000389250
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51536 - protein, 383 aa, Homo sapiens
  Payload ID: 10267
  Gene Symbol: MAPT
  Gene Name: microtubule-associated protein tau
  Uniprot ID: P10636
  ENSP ID: ENSP00000408975
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51537 - protein, 776 aa, Homo sapiens; identical to SEQ ID NO: 51534
  Payload ID: 10267
  Gene Symbol: MAPT
  Gene Name: microtubule-associated protein tau
  Uniprot ID: P10636
  ENSP ID: ENSP00000410838

SEQ ID NO: 51538 - protein, 412 aa, Homo sapiens; identical to SEQ ID NO: 51533
  Payload ID: 10267
  Gene Symbol: MAPT
  Gene Name: microtubule-associated protein tau
  Uniprot ID: P10636
  ENSP ID: ENSP00000413056

SEQ ID NO: 51539 - protein, 410 aa, Homo sapiens; identical to SEQ ID NO: 51535
  Payload ID: 10267
  Gene Symbol: MAPT
  Gene Name: microtubule-associated protein tau
  Uniprot ID: P10636
  ENSP ID: ENSP00000443028

SEQ ID NO: 51540 - protein, 758 aa, Homo sapiens; identical to SEQ ID NO: 51530
  Payload ID: 10267
  Gene Symbol: MAPT
  Gene Name: microtubule-associated protein tau
  Uniprot ID: P10636
  ENSP ID: ENSP00000458742

SEQ ID NO: 51541 - protein, 59 aa, Homo sapiens
  Payload ID: 10267
  Gene Symbol: MAPT
  Gene Name: microtubule-associated protein tau
  ENSP ID: ENSP00000460048
MAEPRQEFEVMEDHAGTYGLGDRKDQGGYTMHQDQEGDTDAGLKEGSEFTELRAEEPLI

SEQ ID NO: 51542 - protein, 441 aa, Homo sapiens; identical to SEQ ID NO: 51531
  Payload ID: 10267
  Gene Symbol: MAPT
  Gene Name: microtubule-associated protein tau
  Uniprot ID: P10636
  ENSP ID: ENSP00000460965

SEQ ID NO: 51543 - protein, 441 aa, Homo sapiens; identical to SEQ ID NO: 51531
  Payload ID: 10267
  Gene Symbol: MAPT
  Gene Name: microtubule-associated protein tau
  Uniprot ID: P10636
  ENSP ID: ENSP00000477703

SEQ ID NO: 51544 - protein, 412 aa, Homo sapiens; identical to SEQ ID NO: 51533
  Payload ID: 10267
  Gene Symbol: MAPT
  Gene Name: microtubule-associated protein tau
  Uniprot ID: P10636
  ENSP ID: ENSP00000478602

SEQ ID NO: 51545 - protein, 383 aa, Homo sapiens; identical to SEQ ID NO: 51536
  Payload ID: 10267
  Gene Symbol: MAPT
  Gene Name: microtubule-associated protein tau
  Uniprot ID: P10636
  ENSP ID: ENSP00000479142

SEQ ID NO: 51546 - protein, 776 aa, Homo sapiens
  Payload ID: 10267
  Gene Symbol: MAPT
  Gene Name: microtubule-associated protein tau
  ENSP ID: ENSP00000480217
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKTSTRSSAKTLKNRPCLSPKHPTPGSSDPLIQPSSPAVCPEPPSSPKHVSSVTSRTGSSGAKEMKLKGADGKTKIATPRGAAPPGQKGQANATRIPAKTPPAPKTPPSSATKQVQRRPPPAGPRSERGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51547 - protein, 410 aa, Homo sapiens; identical to SEQ ID NO: 51535
  Payload ID: 10267
  Gene Symbol: MAPT
  Gene Name: microtubule-associated protein tau
  Uniprot ID: P10636
  ENSP ID: ENSP00000481769

SEQ ID NO: 51548 - protein, 383 aa, Homo sapiens; identical to SEQ ID NO: 51536
  Payload ID: 10267
  Gene Symbol: MAPT
  Gene Name: microtubule-associated protein tau
  Uniprot ID: P10636
  ENSP ID: ENSP00000482244

SEQ ID NO: 51549 - protein, 758 aa, Homo sapiens
  Payload ID: 10267
  Gene Symbol: MAPT
  Gene Name: microtubule-associated protein tau
  ENSP ID: ENSP00000483396
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKTSTRSSAKTLKNRPCLSPKHPTPGSSDPLIQPSSPAVCPEPPSSPKHVSSVTSRTGSSGAKEMKLKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51550 - protein, 412 aa, Homo sapiens; identical to SEQ ID NO: 51533
  Payload ID: 10267
  Gene Symbol: MAPT
  Gene Name: microtubule-associated protein tau
  Uniprot ID: P10636
  ENSP ID: ENSP00000483784

SEQ ID NO: 51551 - protein, 410 aa, Homo sapiens; identical to SEQ ID NO: 51535
  Payload ID: 10267
  Gene Symbol: MAPT
  Gene Name: microtubule-associated protein tau
  Uniprot ID: P10636
  ENSP ID: ENSP00000484321

SEQ ID NO: 51552 - protein, 441 aa, Homo sapiens; identical to SEQ ID NO: 51531
  Payload ID: 10267
  Gene Symbol: MAPT
  Gene Name: microtubule-associated protein tau
  Uniprot ID: P10636
  ENSP ID: ENSP00000484491

SEQ ID NO: 51553 - protein, 59 aa, Homo sapiens; identical to SEQ ID NO: 51541
  Payload ID: 10267
  Gene Symbol: MAPT
  Gene Name: microtubule-associated protein tau
  ENSP ID: ENSP00000485831

SEQ ID NO: 51554 - protein, 758 aa, Homo sapiens
  Payload ID: 10267
  Gene Symbol: MAPT
  Gene Name: microtubule-associated protein tau
  ENSP ID: ENSP00000485913
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPLLKGAGGKERPGSKEEVDEDRDVDESSPQDSPPSKASPAQDGRPPQTAAREATSIPGFPAEGAIPLPVDFLSKVSTEIPASEPNGPSAGRAKGQDAPLEFTFHVEITPNVQKEQAHSEEHLGRAAFPGAPGEGPEARGPSLGEDTKEADLPEPSEKQPAAAPRGKPVSWVPQLKARMVSKSKDGTGSDDKKAKTSTRSSAKTLKNRPCLSPKHPTPGSSDPLIQPSSPAVCPEPPSSPKYVSSVTPRTGSSGAKEMKLKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51555 - protein, 383 aa, Homo sapiens; identical to SEQ ID NO: 51536
  Payload ID: 10267
  Gene Symbol: MAPT
  Gene Name: microtubule-associated protein tau
  Uniprot ID: P10636
  ENSP ID: ENSP00000486039

SEQ ID NO: 51556 - protein, 776 aa, Homo sapiens
  Payload ID: 10267
  Gene Symbol: MAPT
  Gene Name: microtubule-associated protein tau
  ENSP ID: ENSP00000487403
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPLLKGAGGKERPGSKEEVDEDRDVDESSPQDSPPSKASPAQDGRPPQTAAREATSIPGFPAEGAIPLPVDFLSKVSTEIPASEPNGPSAGRAKGQDAPLEFTFHVEITPNVQKEQAHSEEHLGRAAFPGAPGEGPEARGPSLGEDTKEADLPEPSEKQPAAAPRGKPVSWVPQLKARMVSKSKDGTGSDDKKAKTSTRSSAKTLKNRPCLSPKHPTPGSSDPLIQPSSPAVCPEPPSSPKYVSSVTPRTGSSGAKEMKLKGADGKTKIATPRGAAPPGQKGQANATRIPAKTPPAPKTPPSSATKQVQRRPPPAGPRSERGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51557 - protein, 352 aa, Homo sapiens; identical to SEQ ID NO: 51532
  Payload ID: 10267
  Gene Symbol: MAPT
  Gene Name: microtubule-associated protein tau
  Uniprot ID: P10636
  ENSP ID: ENSP00000487570

SEQ ID NO: 51558 - protein, 59 aa, Homo sapiens; identical to SEQ ID NO: 51541
  Payload ID: 10267
  Gene Symbol: MAPT
  Gene Name: microtubule-associated protein tau
  ENSP ID: ENSP00000487613

SEQ ID NO: 51559 - protein, 441 aa, Homo sapiens; identical to SEQ ID NO: 51531
  Payload ID: 10267
  Gene Symbol: MAPT
  Gene Name: microtubule-associated protein tau
  Uniprot ID: P10636
  ENSP ID: ENSP00000487819

SEQ ID NO: 51560 - protein, 412 aa, Homo sapiens; identical to SEQ ID NO: 51533
  Payload ID: 10267
  Gene Symbol: MAPT
  Gene Name: microtubule-associated protein tau
  Uniprot ID: P10636
  ENSP ID: ENSP00000487837

SEQ ID NO: 51561 - protein, 776 aa, Homo sapiens; identical to SEQ ID NO: 51546
  Payload ID: 10267
  Gene Symbol: MAPT
  Gene Name: microtubule-associated protein tau
  ENSP ID: ENSP00000488046

SEQ ID NO: 51562 - protein, 758 aa, Homo sapiens; identical to SEQ ID NO: 51549
  Payload ID: 10267
  Gene Symbol: MAPT
  Gene Name: microtubule-associated protein tau
  ENSP ID: ENSP00000488081

SEQ ID NO: 51563 - protein, 341 aa, Homo sapiens
  Payload ID: 10267
  Gene Symbol: MAPT
  Gene Name: microtubule-associated protein tau
  ENSP ID: ENSP00000488101
MFKGKCPKVQRAWFLVNNNCLAFTPLHLLTHTPAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 51564 - protein, 352 aa, Homo sapiens; identical to SEQ ID NO: 51532
  Payload ID: 10267
  Gene Symbol: MAPT
  Gene Name: microtubule-associated protein tau
  Uniprot ID: P10636
  ENSP ID: ENSP00000488245

SEQ ID NO: 51565 - protein, 410 aa, Homo sapiens; identical to SEQ ID NO: 51535
  Payload ID: 10267
  Gene Symbol: MAPT
  Gene Name: microtubule-associated protein tau
  Uniprot ID: P10636
  ENSP ID: ENSP00000488373

SEQ ID NO: 51566 - protein, 268 aa, Homo sapiens
  Payload ID: 10268
  Gene Symbol: MAPRE1
  Gene Name: microtubule-associated protein, RP/EB family, member 1
  Uniprot ID: Q15691
  ENSP ID: ENSP00000364721
MAVNVYSTSVTSDNLSRHDMLAWINESLQLNLTKIEQLCSGAAYCQFMDMLFPGSIALKKVKFQAKLEHEYIQNFKILQAGFKRMGVDKIIPVDKLVKGKFQDNFEFVQWFKKFFDANYDGKDYDPVAARQGQETAVAPSLVAPALNKPKKPLTSSSAAPQRPISTQRTAAAPKAGPGVVRKNPGVGNGDDEAAELMQQVNVLKLTVEDLEKERDFYFGKLRNIELICQENEGENDPVLQRIVDILYATDEGFVIPDEGGPQEEQEEY

SEQ ID NO: 51567 - protein, 327 aa, Homo sapiens
  Payload ID: 10269
  Gene Symbol: MAPRE2
  Gene Name: microtubule-associated protein, RP/EB family, member 2
  Uniprot ID: Q15555
  ENSP ID: ENSP00000300249
MPGPTQTLSPNGENNNDIIQDNNGTIIPFRKHTVRGERSYSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 51568 - protein, 284 aa, Homo sapiens
  Payload ID: 10269
  Gene Symbol: MAPRE2
  Gene Name: microtubule-associated protein, RP/EB family, member 2
  Uniprot ID: Q15555
  ENSP ID: ENSP00000396074
MAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 51569 - protein, 315 aa, Homo sapiens
  Payload ID: 10269
  Gene Symbol: MAPRE2
  Gene Name: microtubule-associated protein, RP/EB family, member 2
  Uniprot ID: Q15555
  ENSP ID: ENSP00000407723
MKQNRDQKCPVSQRNSSFQQPGRKPGCSSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 51570 - protein, 274 aa, Homo sapiens
  Payload ID: 10269
  Gene Symbol: MAPRE2
  Gene Name: microtubule-associated protein, RP/EB family, member 2
  Uniprot ID: Q15555
  ENSP ID: ENSP00000446343
MARTTTTSSRIITGPSFLSGSTQCAGSVPTGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 51571 - protein, 284 aa, Homo sapiens; identical to SEQ ID NO: 51568
  Payload ID: 10269
  Gene Symbol: MAPRE2
  Gene Name: microtubule-associated protein, RP/EB family, member 2
  Uniprot ID: Q15555
  ENSP ID: ENSP00000464921

SEQ ID NO: 51572 - protein, 134 aa, Homo sapiens
  Payload ID: 10269
  Gene Symbol: MAPRE2
  Gene Name: microtubule-associated protein, RP/EB family, member 2
  ENSP ID: ENSP00000465939
MTSLHGLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRAS

SEQ ID NO: 51573 - protein, 78 aa, Homo sapiens
  Payload ID: 10269
  Gene Symbol: MAPRE2
  Gene Name: microtubule-associated protein, RP/EB family, member 2
  ENSP ID: ENSP00000466871
MAVNVYSTSITQETMSRHDIIAWVNDIVSLNYTKVEQLCSGAAYCQFMDMLFPGCISLKKVKFQAKLEHEYIHNFKLL

SEQ ID NO: 51574 - protein, 194 aa, Homo sapiens
  Payload ID: 10269
  Gene Symbol: MAPRE2
  Gene Name: microtubule-associated protein, RP/EB family, member 2
  ENSP ID: ENSP00000468216
MAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSD

SEQ ID NO: 51575 - protein, 259 aa, Homo sapiens
  Payload ID: 10269
  Gene Symbol: MAPRE2
  Gene Name: microtubule-associated protein, RP/EB family, member 2
  Uniprot ID: Q15555
  ENSP ID: ENSP00000468588
MPGPTQTLSPNGENNNDIIQDNNGTIIPFRKHTVRGERSYSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVMHQLWPRL

SEQ ID NO: 51576 - protein, 127 aa, Homo sapiens
  Payload ID: 10269
  Gene Symbol: MAPRE2
  Gene Name: microtubule-associated protein, RP/EB family, member 2
  ENSP ID: ENSP00000468904
MAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPV

SEQ ID NO: 51577 - protein, 281 aa, Homo sapiens
  Payload ID: 10270
  Gene Symbol: MAPRE3
  Gene Name: microtubule-associated protein, RP/EB family, member 3
  Uniprot ID: Q9UPY8
  ENSP ID: ENSP00000233121
MAVNVYSTSVTSENLSRHDMLAWVNDSLHLNYTKIEQLCSGAAYCQFMDMLFPGCVHLRKVKFQAKLEHEYIHNFKVLQAAFKKMGVDKIIPVEKLVKGKFQDNFEFIQWFKKFFDANYDGKDYNPLLARQGQDVAPPPNPGDQIFNKSKKLIGTAVPQRTSPTGPKNMQTSGRLSNVAPPCILRKNPPSARNGGHETDAQILELNQQLVDLKLTVDGLEKERDFYFSKLRDIELICQEHESENSPVISGIIGILYATEEGFAPPEDDEIEEHQQEDQDEY

SEQ ID NO: 51578 - protein, 266 aa, Homo sapiens
  Payload ID: 10270
  Gene Symbol: MAPRE3
  Gene Name: microtubule-associated protein, RP/EB family, member 3
  Uniprot ID: Q9UPY8
  ENSP ID: ENSP00000383915
MAVNVYSTSVTSENLSRHDMLAWVNDSLHLNYTKIEQLCSGAAYCQFMDMLFPGCVHLRKVKFQAKLEHEYIHNFKVLQAAFKKMGVDKIIPVEKLVKGKFQDNFEFIQWFKKFFDANYDGKDYNPLLARQGQDVAPPPNPVPQRTSPTGPKNMQTSGRLSNVAPPCILRKNPPSARNGGHETDAQILELNQQLVDLKLTVDGLEKERDFYFSKLRDIELICQEHESENSPVISGIIGILYATEEGFAPPEDDEIEEHQQEDQDEY

SEQ ID NO: 51579 - protein, 266 aa, Homo sapiens; identical to SEQ ID NO: 51578
  Payload ID: 10270
  Gene Symbol: MAPRE3
  Gene Name: microtubule-associated protein, RP/EB family, member 3
  Uniprot ID: Q9UPY8
  ENSP ID: ENSP00000385715

SEQ ID NO: 51580 - protein, 218 aa, Homo sapiens
  Payload ID: 10270
  Gene Symbol: MAPRE3
  Gene Name: microtubule-associated protein, RP/EB family, member 3
  ENSP ID: ENSP00000391705
MAVNVYSTSVTSENLSRHDMLAWVNDSLHLNYTKIEQLCSGAAYCQFMDMLFPGCVHLRKVKFQAKLEHEYIHNFKVLQAAFKKMGVDKIIPVEKLVKGKFQDNFEFIQWFKKFFDANYDGKDYNPLLARQGQDVAPPPNPGDQIFNKSKKLIGTAVPQRTSPTGPKNMQTSGRLSNVAPPCILRKNPPSARNGGHETDAQILELNQQLVDLKLTVDG

SEQ ID NO: 51581 - protein, 183 aa, Homo sapiens
  Payload ID: 10271
  Gene Symbol: MID1IP1
  Gene Name: MID1 interacting protein 1
  Uniprot ID: Q9NPA3
  ENSP ID: ENSP00000338706
MMQICDTYNQKHSLFNAMNRFIGAVNNMDQTVMVPSLLRDVPLADPGLDNDVGVEVGGSGGCLEERTPPVPDSGSANGSFFAPSRDMYSHYVLLKSIRNDIEWGVLHQPPPPAGSEEGSAWKSKDILVDLGHLEGADAGEEDLEQQFHYHLRGLHTVLSKLTRKANILTNRYKQEIGFGNWGH

SEQ ID NO: 51582 - protein, 183 aa, Homo sapiens; identical to SEQ ID NO: 51581
  Payload ID: 10271
  Gene Symbol: MID1IP1
  Gene Name: MID1 interacting protein 1
  Uniprot ID: Q9NPA3
  ENSP ID: ENSP00000367735

SEQ ID NO: 51583 - protein, 183 aa, Homo sapiens; identical to SEQ ID NO: 51581
  Payload ID: 10271
  Gene Symbol: MID1IP1
  Gene Name: MID1 interacting protein 1
  Uniprot ID: Q9NPA3
  ENSP ID: ENSP00000416670

SEQ ID NO: 51584 - protein, 183 aa, Homo sapiens; identical to SEQ ID NO: 51581
  Payload ID: 10271
  Gene Symbol: MID1IP1
  Gene Name: MID1 interacting protein 1
  Uniprot ID: Q9NPA3
  ENSP ID: ENSP00000483547

SEQ ID NO: 51585 - protein, 5596 aa, Homo sapiens
  Payload ID: 10272
  Gene Symbol: MDN1
  Gene Name: midasin AAA ATPase 1
  Uniprot ID: Q9NU22
  ENSP ID: ENSP00000358400
MEHFLLEVAAAPLRLIAAKNEKSRSELGRFLAKQVWTPQDRQCVLSTLAQLLLDKDCTVLVGRQLRPLLLDLLERNAEAIKAGGQINHDLHERLCVSMSKLIGNHPDVLPFALRYFKDTSPVFQRLFLESSDANPVRYGRRRMKLRDLMEAAFKFLQQEQSVFRELWDWSVCVPLLRSHDTLVRWYTANCLALVTCMNEEHKLSFLKKIFNSDELIHFRLRLLEEAQLQDLEKALVLANPEVSLWRKQKELQYLQGHLVSSDLSPRVTAVCGVVLPGQLPAPGELGGNRSSSREQELALRSYVLVESVCKSLQTLAMAVASQNAVLLEGPIGCGKTSLVEYLAAVTGRTKPPQLLKVQLGDQTDSKMLLGMYRCTDVPGEFVWQPGTLTQAATMGHWILLEDIDYAPLDVVSVLIPLLENGELLIPGRGDCLKVAPGFQFFATRRLLSCGGNWYRPLNSHATLLDKYWTKIHLDNLDKRELNEVLQSRYPSLLAVVDHLLDIYIQLTGEKHHSWSDSSVGCEQAPEEVSEARRENKRPTLEGRELSLRDLLNWCNRIAHSFDSSSLSASLNIFQEALDCFTAMLSEHTSKLKMAEVIGSKLNISRKKAEFFCQLYKPEIVINELDLQVGRVRLLRKQSEAVHLQREKFTFAATRPSSVLIEQLAVCVSKGEPVLLVGETGTGKTSTIQYLAHITGHRLRVVNMNQQSDTADLLGGYKPVDHKLIWLPLREAFEELFAQTFSKKQNFTFLGHIQTCYRQKRWHDLLRLMQHVHKSAVNKDGKDSETGLLIKEKWEAFGLRLNHAQQQMKMTENTLLFAFVEGTLAQAVKKGEWILLDEINLAAPEILECLSGLLEGSSGSLVLLDRGDTEPLVRHPDFRLFACMNPATDVGKRNLPPGIRNRFTELYVEELESKEDLQVLIVDYLKGLSVNKNTVQGIINFYTALRKESGTKLVDGTGHRPHYSLRTLCRALRFAASNPCGNIQRSLYEGFCLGFLTQLDRASHPIVQKLICQHIVPGNVKSLLKQPIPEPKGGRLIQVEGYWIAVGDKEPTIDETYILTSSVKLNLRDIVRVVSAGTYPVLIQGETSVGKTSLIQWLAAATGNHCVRINNHEHTDIQEYIGCYTSDSSGKLVFKEGVLIDAMRKGYWIILDELNLAPTDVLEALNRLLDDNRELLVTETQEVVKAHPRFMLFATQNPPGLYGGRKVLSRAFRNRFVELHFDELPSSELETILHKRCSLPPSYCSKLVKVMLDLQSYRRSSSVFAGKQGFITLRDLFRWAERYRLAEPTEKEYDWLQHLANDGYMLLAGRVRKQEEIDVIQEVLEKHFKKKLCPQSLFSKENVLKLLGKLSTQISTLECNFGHIVWTEGMRRLAMLVGRALEFGEPVLLVGDTGCGKTTICQVFAALANQKLYSVSCHLHMETSDFLGGLRPVRQKPNDKEEIDTSRLFEWHDGPLVQAMKEDGFFLLDEISLADDSVLERLNSVLEVEKSLVLAEKGSPEDKDSEIELLTAGKKFRILATMNPGGDFGKKELSPALRNRFTEIWCPQSTSREDLIQIISHNLRPGLCLGRIDPKGSDIPEVMLDFIDWLTHQEFGRKCVVSIRDILSWVNFMNKMGEEAALKRPEIISTVTSFVHAACLVYIDGIGSGVTSSGFGTALLARKECLKFLIKRLAKIVRLTEYQKNELKIYDRMKAKEFTGIDNLWGIHPFFIPRGPVLHRNNIADYALSAGTTAMNAQRLLRATKLKKPILLEGSPGVGKTSLVGALAKASGNTLVRINLSEQTDITDLFGADLPVEGGKGGEFAWRDGPLLAALKAGHWVVLDELNLASQSVLEGLNACFDHRGEIYVPELGMSFQVQHEKTKIFGCQNPFRQGGGRKGLPRSFLNRFTQVFVDPLTVIDMEFIASTLFPAIEKNIVKKMVAFNNQIDHEVTVEKKWGQKGGPWEFNLRDLFRWCQLMLVDQSPGCYDPGQHVFLVYGERMRTEEDKKKVIAVFKDVFGSNSNPYMGTRLFRITPYDVQLGYSVLSRGSCVPHPSRHPLLLLHQSFQPLESIMKCVQMSWMVILVGPASVGKTSLVQLLAHLTGHTLKIMAMNSAMDTTELLGGFEQVDLIRPWRRLLEKVEGTVRALLRDSLLISADDAEVVLRAWSHFLLTYKPKCLGEGGKAITMEIVNKLEAVLLLMQRLNNKINSYCKAEFAKLVEEFRSFGVKLTQLASGHSHGTFEWVDSMLVQALKSGDWLLMDNVNFCNPSVLDRLNALLEPGGVLTISERGMIDGSTPTITPNPNFRLFLSMDPVHGDISRAMRNRGLEIYISGEGDASTPDNLDLKVLLHSLGLVGNSVCDILLALHTETRSTVVGSPTSSVSTLIQTAILIVQYLQRGLSLDRAFSEACWEVYVCSQHSPANRKLVQALLEKHVSSLRAHETWGDSILGMGLWPDSVPSALFATEDSHLSTVRRDGQILVYCLNRMSMKTSSWTRSQPFTLQDLEKIMQSPSPENLKFNAVEVNTYWIDEPDVLVMAVKLLIERATNQDWMLRVKWLYHLAKNIPQGLESIQIHLEASAASLRNFYSHSLSGAVSNVFKILQPNTTDEFVIPLDPRWNMQALDMIRNLMDFDPQTDQPDQLFALLESAANKTIIYLDREKRVFTEANLVSVGSKKLRESVLRMSFEFHQDPESYHTLPHEIVVNLAAFFELCDALVLLWVQSSQGMVSDASANEILGSLRWRDRFWTVADTVKVDAPGLALLALHWHWVLKHLVHQIPRLLMNYEDKYYKEVQTVSEHIQNCLGSQTGGFAGIKKLQKFLGRPFPFKDKLVVECFSQLKVLNKVLAIREQMSALGESGWQEDINRLQVVASQWTLKKSLLQAWGLILRANILEDVSLDELKNFVHAQCLELKAKGLSLGFLEKKHDEASSLSHPDLTSVIHLTRSVQLWPAMEYLAMLWRYKVTADFMAQACLRRCSKNQQPQINEEISHLISFCLYHTPVTPQELRDLWSLLHHQKVSPEEITSLWSELFNSMFMSFWSSTVTTNPEYWLMWNPLPGMQQREAPKSVLDSTLKGPGNLNRPIFSKCCFEVLTSSWRASPWDVSGLPILSSSHVTLGEWVERTQQLQDISSMLWTNMAISSVAEFRRTDSQLQGQVLFRHLAGLAELLPESRRQEYMQNCEQLLLGSSQAFQHVGQTLGDMAGQEVLPKELLCQLLTSLHHFVGEGESKRSLPEPAQRGSLWVSLGLLQIQTWLPQARFDPAVKREYKLNYVKEELHQLQCEWKTRNLSSQLQTGRDLEDEVVVSYSHPHVRLLRQRMDRLDNLTCHLLKKQAFRPQLPAYESLVQEIHHYVTSIAKAPAVQDLLTRLLQALHIDGPRSAQVAQSLLKEEASWQQSHHQFRKRLSEEYTFYPDAVSPLQASILQLQHGMRLVASELHTSLHSSMVGADRLGTLATALLAFPSVGPTFPTYYAHADTLCSVKSEEVLRGLGKLILKRSGGKELEGKGQKACPTREQLLMNALLYLRSHVLCKGELDQRALQLFRHVCQEIISEWDEQERIAQEKAEQESGLYRYRSRNSRTALSEEEEEEREFRKQFPLHEKDFADILVQPTLEENKGTSDGQEEEAGTNPALLSQNSMQAVMLIHQQLCLNFARSLWYQQTLPPHEAKHYLSLFLSCYQTGASLVTHFYPLMGVELNDRLLGSQLLACTLSHNTLFGEAPSDLMVKPDGPYDFYQHPNVPEARQCQPVLQGFSEAVSHLLQDWPEHPALEQLLVVMDRIRSFPLSSPISKFLNGLEILLAKAQDWEENASRALSLRKHLDLISQMIIRWRKLELNCWSMSLDNTMKRHTEKSTKHWFSIYQMLEKHMQEQTEEQEDDKQMTLMLLVSTLQAFIEGSSLGEFHVRLQMLLVFHCHVLLMPQVEGKDSLCSVLWNLYHYYKQFFDRVQAKIVELRSPLEKELKEFVKISKWNDVSFWSIKQSVEKTHRTLFKFMKKFEAVLSEPCRSSLVESDKEEQPDFLPRPTDGAASELSSIQNLNRALRETLLAQPAAGQATIPEWCQGAAPSGLEGELLRRLPKLRKRMRKMCLTFMKESPLPRLVEGLDQFTGEVISSVSELQSLKVEPSAEKEKQRSEAKHILMQKQRALSDLFKHLAKIGLSYRKGLAWARSKNPQEMLHLHPLDLQSALSIVSSTQEADSRLLTEISSSWDGCQKYFYRSLARHARLNAALATPAKEMGMGNVERCRGFSAHLMKMLVRQRRSLTTLSEQWIILRNLLSCVQEIHSRLMGPQAYPVAFPPQDGVQQWTERLQHLAMQCQILLEQLSWLLQCCPSVGPAPGHGNVQVLGQPPGPCLEGPELSKGQLCGVVLDLIPSNLSYPSPIPGSQLPSGCRMRKQDHLWQQSTTRLTEMLKTIKTVKADVDKIRQQSCETLFHSWKDFEVCSSALSCLSQVSVHLQGLESLFILPGMEVEQRDSQMALVESLEYVRGEISKAMADFTTWKTHLLTSDSQGGNQMLDEGFVEDFSEQMEIAIRAILCAIQNLEERKNEKAEENTDQASPQEDYAGFERLQSGHLTKLLEDDFWADVSTLHVQKIISAISELLERLKSYGEDGTAAKHLFFSQSCSLLVRLVPVLSSYSDLVLFFLTMSLATHRSTAKLLSVLAQVFTELAQKGFCLPKEFMEDSAGEGATEFHDYEGGGIGEGEGMKDVSDQIGNEEQVEDTFQKGQEKDKEDPDSKSDIKGEDNAIEMSEDFDGKMHDGELEEQEEDDEKSDSEGGDLDKHMGDLNGEEADKLDERLWGDDDEEEDEEEEDNKTEETGPGMDEEDSELVAKDDNLDSGNSNKDKSQQDKKEEKEEAEADDGGQGEDKINEQIDERDYDENEVDPYHGNQEKVPEPEALDLPDDLNLDSEDKNGGEDTDNEEGEEENPLEIKEKPEEAGHEAEERGETETDQNESQSPQEPEEGPSEDDKAEGEEEMDTGADDQDGDAAQHPEEHSEEQQQSVEEKDKEADEEGGENGPADQGFQPQEEEEREDSDTEEQVPEALERKEHASCGQTGVENMQNTQAMELAGAAPEKEQGKEEHGSGAADANQAEGHESNFIAQLASQKHTRKNTQSFKRKPGQADNERSMGDHNERVHKRLRTVDTDSHAEQGPAQQPQAQVEDADAFEHIKQGSDAYDAQTYDVASKEQQQSAKDSGKDQEEEEIEDTLMDTEEQEEFKAADVEQLKPEEIKSGTTAPLGFDEMEVEIQTVKTEEDQDPRTDKAHKETENEKPERSRESTIHTAHQFLMDTIFQPFLKDVNELRQELERQLEMWQPRESGNPEEEKVAAEMWQSYLILTAPLSQRLCEELRLILEPTQAAKLKGDYRTGKRLNIRKVIPYIASQFRKDKIWLRRTKPSKRQYQICLAIDDSSSMVDNHTKQLAFESLAVIGNALTLLEVGQIAVCSFGESVKLLHPFHEQFSDYSGSQILRLCKFQQKKTKIAQFLESVANMFAAAQQLSQNISSETAQLLLVVSDGRGLFLEGKERVLAAVQAARNANIFVIFVVLDNPSSRDSILDIKVPIFKGPGEMPEIRSYMEEFPFPYYIILRDVNALPETLSDALRQWFELVTASDHP

SEQ ID NO: 51586 - protein, 1181 aa, Homo sapiens
  Payload ID: 10272
  Gene Symbol: MDN1
  Gene Name: midasin AAA ATPase 1
  ENSP ID: ENSP00000409664
MEHFLLEVAAAPLRLIAAKNEKSRSELGRFLAKQVWTPQDRQCVLSTLAQLLLDKDCTVLVGRQLRPLLLDLLERNAEAIKAGGQINHDLHERLCVSMSKLIGNHPDVLPFALRYFKDTSPVFQRLFLESSDANPVRYGRRRMKLRDLMEAAFKFLQQEQSVFRELWDWSVCVPLLRSHDTLVRWYTANCLALVTCMNEEHKLSFLKKIFNSDELIHFRLRLLEEAQLQDLEKALVLANPEVSLWRKQKELQYLQGHLVSSDLSPRVTAVCGVVLPGQLPAPGELGGNRSSSREQELALRSYVLVESVCKSLQTLAMAVASQNAVLLEGPIGCGKTSLVEYLAAVTGRTKPPQLLKVQLGDQTDSKMLLGMYRCTDVPGEFVWQPGTLTQAATMGHWILLEDIDYAPLDVVLQSRYPSLLAVVDHLLDIYIQLTGEKHHSWSDSSVGCEQAPEEVSEARRENKRPTLEGRELSLRDLLNWCNRIAHSFDSSSLSASLNIFQEALDCFTAMLSEHTSKLKMAEVIGSKLNISRKKAEFFCQLYKPEIVINELDLQVGRVRLLRKQSEAVHLQREKFTFAATRPSSVLIEQLAVCVSKGEPVLLVGETGTGKTSTIQYLAHITGHRLRVVNMNQQSDTADLLGGYKPVDHKLIWLPLREAFEELFAQTFSKKQNFTFLGHIQTCYRQKRWHDLLRLMQHVHKSAVNKDGKDSETGLLIKEKWEAFGLRLNHAQQQMKMTENTLLFAFVEGTLAQAVKKGEWILLDEINLAAPEILECLSGLLEGSSGSLVLLDRGDTEPLVRHPDFRLFACMNPATDVGKRNLPPGIRNRFTELYVEELESKEDLQVLIVDYLKGLSVNKNTVQGIINFYTALRKESGTKLVDGTGHRPHYSLRTLCRALRFAASNPCGNIQRSLYEGFCLGFLTQLDRASHPIVQKLICQHIVPGNVKSLLKQPIPEPKGGRLIQVEGYWIAVGDKEPTIDETYILTSSVKLNLRDIVRVVSAGTYPVLIQGETSVGKTSLIQWLAAATGNHCVRINNHEHTDIQEYIGCYTSDSSGKLVFKEGVLIDAMRKGYWIILDELNLAPTDVLEALNRLLDDNRELLVTETQEVVKAHPRFMLFATQNPPGLYGGRKVLSRAFRNRFVELHFDELPSSELETILHKRCSLPPSYCSKLVKVMLDLQ

SEQ ID NO: 51587 - protein, 62 aa, Homo sapiens
  Payload ID: 10272
  Gene Symbol: MDN1
  Gene Name: midasin AAA ATPase 1
  ENSP ID: ENSP00000469327
DSILDIKVPIFKGPGEMPEIRSYMEEFPFPYYIILRDVNALPETLSDALRQWFELVTASDHP

SEQ ID NO: 51588 - protein, 5596 aa, Homo sapiens; identical to SEQ ID NO: 51585
  Payload ID: 10272
  Gene Symbol: MDN1
  Gene Name: midasin AAA ATPase 1
  Uniprot ID: Q9NU22
  ENSP ID: ENSP00000486270

SEQ ID NO: 51589 - protein, 143 aa, Homo sapiens
  Payload ID: 10273
  Gene Symbol: MDK
  Gene Name: midkine (neurite growth-promoting factor 2)
  Uniprot ID: P21741
  ENSP ID: ENSP00000352852
MQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTKAKAKAKKGKGKD

SEQ ID NO: 51590 - protein, 143 aa, Homo sapiens; identical to SEQ ID NO: 51589
  Payload ID: 10273
  Gene Symbol: MDK
  Gene Name: midkine (neurite growth-promoting factor 2)
  Uniprot ID: P21741
  ENSP ID: ENSP00000378932

SEQ ID NO: 51591 - protein, 143 aa, Homo sapiens; identical to SEQ ID NO: 51589
  Payload ID: 10273
  Gene Symbol: MDK
  Gene Name: midkine (neurite growth-promoting factor 2)
  Uniprot ID: P21741
  ENSP ID: ENSP00000378933

SEQ ID NO: 51592 - protein, 87 aa, Homo sapiens
  Payload ID: 10273
  Gene Symbol: MDK
  Gene Name: midkine (neurite growth-promoting factor 2)
  Uniprot ID: P21741
  ENSP ID: ENSP00000378936
MQHRGFLLLTLLALLALTSAVAKKKADCKYKFENWGACDGGTGTKVRQGTLKKARYNAQCQETIRVTKPCTPKTKAKAKAKKGKGKD

SEQ ID NO: 51593 - protein, 143 aa, Homo sapiens; identical to SEQ ID NO: 51589
  Payload ID: 10273
  Gene Symbol: MDK
  Gene Name: midkine (neurite growth-promoting factor 2)
  Uniprot ID: P21741
  ENSP ID: ENSP00000384034

SEQ ID NO: 51594 - protein, 143 aa, Homo sapiens; identical to SEQ ID NO: 51589
  Payload ID: 10273
  Gene Symbol: MDK
  Gene Name: midkine (neurite growth-promoting factor 2)
  Uniprot ID: P21741
  ENSP ID: ENSP00000385451

SEQ ID NO: 51595 - protein, 49 aa, Homo sapiens
  Payload ID: 10273
  Gene Symbol: MDK
  Gene Name: midkine (neurite growth-promoting factor 2)
  ENSP ID: ENSP00000416241
MQHRGFLLLTLLALLALTSAVAKKKDKVKKGGPGSECAEWAWGPCTPSS

SEQ ID NO: 51596 - protein, 131 aa, Homo sapiens
  Payload ID: 10273
  Gene Symbol: MDK
  Gene Name: midkine (neurite growth-promoting factor 2)
  ENSP ID: ENSP00000432649
MQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTK

SEQ ID NO: 51597 - protein, 156 aa, Homo sapiens
  Payload ID: 10273
  Gene Symbol: MDK
  Gene Name: midkine (neurite growth-promoting factor 2)
  ENSP ID: ENSP00000433240
MQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTKAKAKGQRKEKGVGLSRGAAPPPPRL

SEQ ID NO: 51598 - protein, 152 aa, Homo sapiens
  Payload ID: 10273
  Gene Symbol: MDK
  Gene Name: midkine (neurite growth-promoting factor 2)
  ENSP ID: ENSP00000480875
MQHRGFLLLTLLALLALTSAVAKKKEEGALQCSVPGDHPRHQALHPQDQSKGQSQEREGKGLDAKPGCQGAPGVTWGLAHALPLPGPRCDPPVPSVCSLALINHALPCPSHSPAPPLSAQSGEGQGILGSLSLPQSNVSPRARFCSSPQFHY

SEQ ID NO: 51599 - protein, 667 aa, Homo sapiens
  Payload ID: 10274
  Gene Symbol: MID1
  Gene Name: midline 1
  Uniprot ID: O15344
  ENSP ID: ENSP00000312678
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTWYAIGLAYKSAPKHEWIGKNSASWALCRCNNNWVVRHNSKEIPIEPAPHLRRVGILLDYDNGSIAFYDALNSIHLYTFDVAFAQPVCPTFTVWNKCLTIITGLPIPDHLDCTEQLP

SEQ ID NO: 51600 - protein, 667 aa, Homo sapiens; identical to SEQ ID NO: 51599
  Payload ID: 10274
  Gene Symbol: MID1
  Gene Name: midline 1
  Uniprot ID: O15344
  ENSP ID: ENSP00000370156

SEQ ID NO: 51601 - protein, 667 aa, Homo sapiens; identical to SEQ ID NO: 51599
  Payload ID: 10274
  Gene Symbol: MID1
  Gene Name: midline 1
  Uniprot ID: O15344
  ENSP ID: ENSP00000370157

SEQ ID NO: 51602 - protein, 552 aa, Homo sapiens
  Payload ID: 10274
  Gene Symbol: MID1
  Gene Name: midline 1
  Uniprot ID: O15344
  ENSP ID: ENSP00000370159
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTW

SEQ ID NO: 51603 - protein, 667 aa, Homo sapiens; identical to SEQ ID NO: 51599
  Payload ID: 10274
  Gene Symbol: MID1
  Gene Name: midline 1
  Uniprot ID: O15344
  ENSP ID: ENSP00000370162

SEQ ID NO: 51604 - protein, 667 aa, Homo sapiens; identical to SEQ ID NO: 51599
  Payload ID: 10274
  Gene Symbol: MID1
  Gene Name: midline 1
  Uniprot ID: O15344
  ENSP ID: ENSP00000370164

SEQ ID NO: 51605 - protein, 197 aa, Homo sapiens
  Payload ID: 10274
  Gene Symbol: MID1
  Gene Name: midline 1
  ENSP ID: ENSP00000387771
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICAL

SEQ ID NO: 51606 - protein, 483 aa, Homo sapiens
  Payload ID: 10274
  Gene Symbol: MID1
  Gene Name: midline 1
  ENSP ID: ENSP00000391154
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNS

SEQ ID NO: 51607 - protein, 667 aa, Homo sapiens; identical to SEQ ID NO: 51599
  Payload ID: 10274
  Gene Symbol: MID1
  Gene Name: midline 1
  Uniprot ID: O15344
  ENSP ID: ENSP00000414521

SEQ ID NO: 51608 - protein, 228 aa, Homo sapiens
  Payload ID: 10274
  Gene Symbol: MID1
  Gene Name: midline 1
  ENSP ID: ENSP00000483707
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKQNLESNLTNLIKRNTELETLLAKLIQTCQHVELECSVLFPRVAQWG

SEQ ID NO: 51609 - protein, 540 aa, Homo sapiens
  Payload ID: 10274
  Gene Symbol: MID1
  Gene Name: midline 1
  ENSP ID: ENSP00000484712
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVETVKDQKVIGREKQQYYPRNRRKWVSNSLQARLMGRRCISRRERKLTLDVEKVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSEYLMAYLFLSLVAFFRLIAFLNLNFKGRQGRKEHTIFIDLSFLNKKVIALTCTTLVKTAG

SEQ ID NO: 51610 - protein, 735 aa, Homo sapiens
  Payload ID: 10275
  Gene Symbol: MID2
  Gene Name: midline 2
  Uniprot ID: Q9UJV3
  ENSP ID: ENSP00000262843
MGESPASVVLNASGGLFSLKMETLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKLKQTLEMNLTNLVKRNSELENQMAKLIQICQQVEVNTAMHEAKLMEECDELVEIIQQRKQMIAVKIKETKVMKLRKLAQQVANCRQCLERSTVLINQAEHILKENDQARFLQSAKNIAERVAMATASSQVLIPDINFNDAFENFALDFSREKKLLEGLDYLTAPNPPSIREELCTASHDTITVHWISDDEFSISSYELQYTIFTGQANFISKSWCSWGLWPEIRKCKEAVSCSRLAGAPRGLYNSVDSWMIVPNIKQNHYTVHGLQSGTRYIFIVKAINQAGSRNSEPTRLKTNSQPFKLDPKMTHKKLKISNDGLQMEKDESSLKKSHTPERFSGTGCYGAAGNIFIDSGCHYWEVVMGSSTWYAIGIAYKSAPKNEWIGKNASSWVFSRCNSNFVVRHNNKEMLVDVPPHLKRLGVLLDYDNNMLSFYDPANSLHLHTFDVTFILPVCPTFTIWNKSLMILSGLPAPDFIDYPERQECNCRPQESPYVSGMKTCH

SEQ ID NO: 51611 - protein, 218 aa, Homo sapiens
  Payload ID: 10275
  Gene Symbol: MID2
  Gene Name: midline 2
  ENSP ID: ENSP00000410730
METLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEK

SEQ ID NO: 51612 - protein, 705 aa, Homo sapiens
  Payload ID: 10275
  Gene Symbol: MID2
  Gene Name: midline 2
  Uniprot ID: Q9UJV3
  ENSP ID: ENSP00000413976
MGESPASVVLNASGGLFSLKMETLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKLKQTLEMNLTNLVKRNSELENQMAKLIQICQQVEVNTAMHEAKLMEECDELVEIIQQRKQMIAVKIKETKVMKLRKLAQQVANCRQCLERSTVLINQAEHILKENDQARFLQSAKNIAERVAMATASSQVLIPDINFNDAFENFALDFSREKKLLEGLDYLTAPNPPSIREELCTASHDTITVHWISDDEFSISSYELQYTIFTGQANFISLYNSVDSWMIVPNIKQNHYTVHGLQSGTRYIFIVKAINQAGSRNSEPTRLKTNSQPFKLDPKMTHKKLKISNDGLQMEKDESSLKKSHTPERFSGTGCYGAAGNIFIDSGCHYWEVVMGSSTWYAIGIAYKSAPKNEWIGKNASSWVFSRCNSNFVVRHNNKEMLVDVPPHLKRLGVLLDYDNNMLSFYDPANSLHLHTFDVTFILPVCPTFTIWNKSLMILSGLPAPDFIDYPERQECNCRPQESPYVSGMKTCH

SEQ ID NO: 51613 - protein, 468 aa, Homo sapiens
  Payload ID: 10276
  Gene Symbol: MIDN
  Gene Name: midnolin
  Uniprot ID: Q504T8
  ENSP ID: ENSP00000300952
MEPQPGGARSCRRGAPGGACELGPAAEAAPMSLAIHSTTGTRYDLAVPPDETVEGLRKRLSQRLKVPKERLALLHKDTRLSSGKLQEFGVGDGSKLTLVPTVEAGLMSQASRPEQSVMQALESLTETQVSDFLSGRSPLTLALRVGDHMMFVQLQLAAQHAPLQHRHVLAAAAAAAAARGDPSIASPVSSPCRPVSSAARVPPVPTSPSPASPSPITAGSFRSHAASTTCPEQMDCSPTASSSASPGASTTSTPGASPAPRSRKPGAVIESFVNHAPGVFSGTFSGTLHPNCQDSSGRPRRDIGTILQILNDLLSATRHYQGMPPSLAQLRCHAQCSPASPAPDLAPRTTSCEKLTAAPSASLLQGQSQIRMCKPPGDRLRQTENRATRCKVERLQLLLQQKRLRRKARRDARGPYHWSPSRKAGRSDSSSSGGGGSPSEASGLGLDFEDSVWKPEVNPDIKSEFVVA

SEQ ID NO: 51614 - protein, 139 aa, Homo sapiens
  Payload ID: 10276
  Gene Symbol: MIDN
  Gene Name: midnolin
  ENSP ID: ENSP00000466835
  MOD_RES (1)..(1): Any amino acid
XRLSSGKLQEFGVGDGSKLTLVPTVEAGLMSQASRPEQSVMQALESLTETQPPAAPGPGRAGGGGFRKYRFILFKRPWHRQGPQSPERGGERPQVSDFLSGRSPLTLALRVGDHMMFVQLQLAAQHAPLQHRHVLAAAA

SEQ ID NO: 51615 - protein, 216 aa, Homo sapiens
  Payload ID: 10276
  Gene Symbol: MIDN
  Gene Name: midnolin
  ENSP ID: ENSP00000466895
MEPQPGGARSCRRGAPGGACELGPAAEAAPMSLAIHSTTGTRYDLAVPPDETVEGLRKRLSQRLKVPKERLALLHKDTRLSSGKLQEFGVGDGSKLTLVPTVEAGLMSQASRPEQSVMQALESLTETQVSDFLSGRSPLTLALRVGDHMMFVQLQLAAQHAPLQHRHVLAAAAAAAAARGDPSIASPVSSPCRPVSSAARVPPVPTSPSPASPSPI

SEQ ID NO: 51616 - protein, 468 aa, Homo sapiens; identical to SEQ ID NO: 51613
  Payload ID: 10276
  Gene Symbol: MIDN
  Gene Name: midnolin
  Uniprot ID: Q504T8
  ENSP ID: ENSP00000467679

SEQ ID NO: 51617 - protein, 256 aa, Homo sapiens
  Payload ID: 10277
  Gene Symbol: MIF4GD
  Gene Name: MIF4G domain containing
  Uniprot ID: A9UHW6
  ENSP ID: ENSP00000245551
MGEPSREEYKIQSFDAETQQLLKTALKVACFETEDGEYSVCQRSYSNCSRLMPSRCNTQYRDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 51618 - protein, 222 aa, Homo sapiens
  Payload ID: 10277
  Gene Symbol: MIF4GD
  Gene Name: MIF4G domain containing
  Uniprot ID: A9UHW6
  ENSP ID: ENSP00000321625
MGEPSREEYKIQSFDAETQQLLKTALKDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 51619 - protein, 170 aa, Homo sapiens
  Payload ID: 10277
  Gene Symbol: MIF4GD
  Gene Name: MIF4G domain containing
  ENSP ID: ENSP00000462412
MGEPSREEYKIQSFDAETQQLLKTALKDPGAVDLEKVANVIVDHSLQDCVFSKEAGRMCYAIIQVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 51620 - protein, 263 aa, Homo sapiens
  Payload ID: 10277
  Gene Symbol: MIF4GD
  Gene Name: MIF4G domain containing
  Uniprot ID: A9UHW6
  ENSP ID: ENSP00000462459
MGEPSREEYKIQSFDAETQQLLKTALKAPSLECTVACFETEDGEYSVCQRSYSNCSRLMPSRCNTQYRDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 51621 - protein, 155 aa, Homo sapiens
  Payload ID: 10277
  Gene Symbol: MIF4GD
  Gene Name: MIF4G domain containing
  ENSP ID: ENSP00000462655
MGEPSREEYKIQSFDAETQQLLKTALKAPSLECTVACFETEDGEYSVCQRSYSNCSRLMPSRCNTQYRDPGAVDLEKVANVIVDHSLQDCVFSKEAGRMCYAIIQAESKQAGQSVFRRGLLNRLQQEYQAREQLRARSLQGWVCYVTFICNIFDY

SEQ ID NO: 51622 - protein, 169 aa, Homo sapiens
  Payload ID: 10277
  Gene Symbol: MIF4GD
  Gene Name: MIF4G domain containing
  ENSP ID: ENSP00000463264
MGEPSREEYKIQSFDAETQQLLKTALKVACFETEDGEYSVCQRSYSNCSRLMPSRCNTQYRDPGAVDLEKVANVIVDHSLQDCVFSKEAGRMCYAIIQVNNMPMMALVNPVYDCLFRLAQPDSLSKEEEVGGPSPGTSTEGCRMDSPAQPCVSPLLTEVDCLVLQLHRV

SEQ ID NO: 51623 - protein, 263 aa, Homo sapiens; identical to SEQ ID NO: 51620
  Payload ID: 10277
  Gene Symbol: MIF4GD
  Gene Name: MIF4G domain containing
  Uniprot ID: A9UHW6
  ENSP ID: ENSP00000463334

SEQ ID NO: 51624 - protein, 90 aa, Homo sapiens
  Payload ID: 10277
  Gene Symbol: MIF4GD
  Gene Name: MIF4G domain containing
  ENSP ID: ENSP00000463493
MGEPSREEYKIQSFDAETQQLLKTALKDPGAVDLEKVANVIVDHSLQDCVFSKEAGRMCYAIIQAESKQAGQSVFRRGLLNRLQQEYQAR

SEQ ID NO: 51625 - protein, 251 aa, Homo sapiens
  Payload ID: 10277
  Gene Symbol: MIF4GD
  Gene Name: MIF4G domain containing
  ENSP ID: ENSP00000463579
MGEPSREEYKIQSFDAETQQLLKTALKDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVGGPSPGTSTEGCRMDSPAQPCVSPLLTEVDCLVLQLHRVGEQLEKMNGQRMDELFVLIRDGFLLPTGLSSLAQLLLLEIIEFRAAGWKTTPAAHKYYYSEVSD

SEQ ID NO: 51626 - protein, 41 aa, Homo sapiens
  Payload ID: 10277
  Gene Symbol: MIF4GD
  Gene Name: MIF4G domain containing
  ENSP ID: ENSP00000463629
MGEPSREEYKIQSFDAETQQLLKTALKGEQHAHDGPGEPCL

SEQ ID NO: 51627 - protein, 204 aa, Homo sapiens
  Payload ID: 10277
  Gene Symbol: MIF4GD
  Gene Name: MIF4G domain containing
  ENSP ID: ENSP00000464448
MGEPSREEYKIQSFDAETQQLLKTALKDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAA

SEQ ID NO: 51628 - protein, 222 aa, Homo sapiens; identical to SEQ ID NO: 51618
  Payload ID: 10277
  Gene Symbol: MIF4GD
  Gene Name: MIF4G domain containing
  Uniprot ID: A9UHW6
  ENSP ID: ENSP00000484245

SEQ ID NO: 51629 - protein, 115 aa, Homo sapiens
  Payload ID: 10278
  Gene Symbol: MIEN1
  Gene Name: migration and invasion enhancer 1
  Uniprot ID: Q9BRT3
  ENSP ID: ENSP00000377778
MSGEPGQTSVAPPPEEVEPGSGVRIVVEYCEPCGFEATYLELASAVKEQYPGIEIESRLGGTGAFEIEINGQLVFSKLENGGFPYEKDLIEAIRRASNGETLEKITNSRPPCVIL

SEQ ID NO: 51630 - protein, 116 aa, Homo sapiens
  Payload ID: 10278
  Gene Symbol: MIEN1
  Gene Name: migration and invasion enhancer 1
  ENSP ID: ENSP00000462998
MSGEPGQTSVAPPPEEVEPGSGVRIVVEYCEPCGFEATYLELASAVKEQYPGIEIESRLGGTGAFEIEINGQLVFSKLENGGFPYEKDVSIYSVGRTSWSPYPNSASSCHSTPLAH

SEQ ID NO: 51631 - protein, 388 aa, Homo sapiens
  Payload ID: 10279
  Gene Symbol: MIIP
  Gene Name: migration and invasion inhibitory protein
  Uniprot ID: Q5JXC2
  ENSP ID: ENSP00000235332
MVEAEELAQLRLLNLELLRQLWVGQDAVRRSVARAASESSLESSSSYNSETPSTPETSSTSLSTSCPRGRSSVWGPPDACRGDLRDVARSGVASLPPAKCQHQESLGRPRPHSAPSLGTSSLRDPEPSGRLGDPGPQEAQTPRSILAQQSKLSKPRVTFSEESAVPKRSWRLRPYLGYDWIAGSLDTSSSITSQPEAFFSKLQEFRETNKEECICSHPEPQLPGLRESSGSGVEEDHECVYCYRVNRRLFPVPVDPGTPCRLCRTPRDQQGPGTLAQPAHVRVSIPLSILEPPHRYHIHRRKSFDASDTLALPRHCLLGWDIFPPKSEKSSAPRNLDLWSSVSAEAQHQKLSGTSSPFHPASPMQMLPPTPTWSVPQVPRPHVPRQKP

SEQ ID NO: 51632 - protein, 387 aa, Homo sapiens
  Payload ID: 10280
  Gene Symbol: MFGE8
  Gene Name: milk fat globule-EGF factor 8 protein
  Uniprot ID: Q08431
  ENSP ID: ENSP00000268150
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 51633 - protein, 335 aa, Homo sapiens
  Payload ID: 10280
  Gene Symbol: MFGE8
  Gene Name: milk fat globule-EGF factor 8 protein
  ENSP ID: ENSP00000268151
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQIFPGNWDNHSHKKNLFETPILARYVRILPVAWHNRIALRLELLGC

SEQ ID NO: 51634 - protein, 343 aa, Homo sapiens
  Payload ID: 10280
  Gene Symbol: MFGE8
  Gene Name: milk fat globule-EGF factor 8 protein
  ENSP ID: ENSP00000444332
MPRPRLLAALCGALLCAPSLLVALECVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 51635 - protein, 25 aa, Homo sapiens
  Payload ID: 10280
  Gene Symbol: MFGE8
  Gene Name: milk fat globule-EGF factor 8 protein
  ENSP ID: ENSP00000452734
MPRPRLLAALCGALLCAPSLLVALG

SEQ ID NO: 51636 - protein, 268 aa, Homo sapiens
  Payload ID: 10280
  Gene Symbol: MFGE8
  Gene Name: milk fat globule-EGF factor 8 protein
  ENSP ID: ENSP00000452926
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNAATRPGACISSAGTPPMHGWTSRATSTPGLRGATVTISGC

SEQ ID NO: 51637 - protein, 387 aa, Homo sapiens; identical to SEQ ID NO: 51632
  Payload ID: 10280
  Gene Symbol: MFGE8
  Gene Name: milk fat globule-EGF factor 8 protein
  Uniprot ID: Q08431
  ENSP ID: ENSP00000456281

SEQ ID NO: 51638 - protein, 75 aa, Homo sapiens
  Payload ID: 10280
  Gene Symbol: MFGE8
  Gene Name: milk fat globule-EGF factor 8 protein
  ENSP ID: ENSP00000478952
FDFIHDVNKKHKEFVGNWNKNAVHVNLFETPVEAQYVRLYPTSCHTACTLRFELLGCELNARKADLRRGADDREQ

SEQ ID NO: 51639 - protein, 1006 aa, Homo sapiens
  Payload ID: 10281
  Gene Symbol: MIB1
  Gene Name: mindbomb E3 ubiquitin protein ligase 1
  Uniprot ID: Q86YT6
  ENSP ID: ENSP00000261537
MSNSRNNRVMVEGVGARVVRGPDWKWGKQDGGEGHVGTVRSFESPEEVVVVWDNGTAANYRCSGAYDLRILDSAPTGIKHDGTMCDTCRQQPIIGIRWKCAECTNYDLCTVCYHGDKHHLRHRFYRITTPGSERVLLESRRKSKKITARGIFAGARVVRGVDWQWEDQDGGNGRRGKVTEIQDWSASSPHSAAYVLWDNGAKNLYRVGFEGMSDLKCVQDAKGGSFYRDHCPVLGEQNGNRNPGGLQIGDLVNIDLDLEIVQSLQHGHGGWTDGMFETLTTTGTVCGIDEDHDIVVQYPSGNRWTFNPAVLTKANIVRSGDAAQGAEGGTSQFQVGDLVQVCYDLERIKLLQRGHGEWAEAMLPTLGKVGRVQQIYSDSDLKVEVCGTSWTYNPAAVSKVASAGSAISNASGERLSQLLKKLFETQESGDLNEELVKAAANGDVAKVEDLLKRPDVDVNGQCAGHTAMQAASQNGHVDILKLLLKQNVDVEAEDKDGDRAVHHAAFGDEGAVIEVLHRGSADLNARNKRRQTPLHIAVNKGHLQVVKTLLDFGCHPSLQDSEGDTPLHDAISKKRDDILAVLLEAGADVTITNNNGFNALHHAALRGNPSAMRVLLSKLPRPWIVDEKKDDGYTALHLAALNNHVEVAELLVHQGNANLDIQNVNQQTALHLAVERQHTQIVRLLVRAGAKLDIQDKDGDTPLHEALRHHTLSQLRQLQDMQDVGKVDAAWEPSKNTLIMGLGTQGAEKKSAASIACFLAANGADLSIRNKKGQSPLDLCPDPNLCKALAKCHKEKVSGQVGSRSPSMISNDSETLEECMVCSDMKRDTLFGPCGHIATCSLCSPRVKKCLICKEQVQSRTKIEECVVCSDKKAAVLFQPCGHMCACENCANLMKKCVQCRAVVERRVPFIMCCGGKSSEDATDDISSGNIPVLQKDKDNTNVNADVQKLQQQLQDIKEQTMCPVCLDRLKNMIFLCGHGTCQLCGDRMSECPICRKAIERRILLY

SEQ ID NO: 51640 - protein, 1056 aa, Homo sapiens
  Payload ID: 10282
  Gene Symbol: MIB2
  Gene Name: mindbomb E3 ubiquitin protein ligase 2
  Uniprot ID: Q96AX9
  ENSP ID: ENSP00000348081
MAGALRRGRALGSRPSGPTVSSRRSPQCPVAQEGLGARSRPRVAPRSLARCGPSSRLMGWKPSEARGQSQSFQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 51641 - protein, 919 aa, Homo sapiens
  Payload ID: 10282
  Gene Symbol: MIB2
  Gene Name: mindbomb E3 ubiquitin protein ligase 2
  ENSP ID: ENSP00000367980
MDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 51642 - protein, 753 aa, Homo sapiens
  Payload ID: 10282
  Gene Symbol: MIB2
  Gene Name: mindbomb E3 ubiquitin protein ligase 2
  Uniprot ID: Q96AX9
  ENSP ID: ENSP00000367984
MDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRVRAQDEEVHQVPGGRQQETAPRRL

SEQ ID NO: 51643 - protein, 114 aa, Homo sapiens
  Payload ID: 10282
  Gene Symbol: MIB2
  Gene Name: mindbomb E3 ubiquitin protein ligase 2
  ENSP ID: ENSP00000420935
MGWKPSEARGQSQSFQASGLQPRSLKAARRATGRPDRSRAAPPNMDPDPQAGVQASGTPTSSVTAARSTGCGGCAGSAVCAWTTTSARSATCTTSMSSPTPSTATRPLTRALSH

SEQ ID NO: 51644 - protein, 84 aa, Homo sapiens
  Payload ID: 10282
  Gene Symbol: MIB2
  Gene Name: mindbomb E3 ubiquitin protein ligase 2
  ENSP ID: ENSP00000423221
MDPDPQAGVQVGMRVVRGVDWKWGQQDGGEGGVGTVVELGRHGSPSTPDRTVVVQWDQGTRTNYRAGYQGAHDLLLRPAPQHHL

SEQ ID NO: 51645 - protein, 816 aa, Homo sapiens
  Payload ID: 10282
  Gene Symbol: MIB2
  Gene Name: mindbomb E3 ubiquitin protein ligase 2
  ENSP ID: ENSP00000424615
MDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGR

SEQ ID NO: 51646 - protein, 395 aa, Homo sapiens
  Payload ID: 10282
  Gene Symbol: MIB2
  Gene Name: mindbomb E3 ubiquitin protein ligase 2
  ENSP ID: ENSP00000425032
MDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEHHSFWVGDVVRVIGDLDTVKRLQAGHGEWTDDMAPALGRVGKVVKVFGDGNLRVAVAGQRWTFSPSCLVAYRPEEDANLDVAERARENKSAAQLRRPVGGGAAPGHH

SEQ ID NO: 51647 - protein, 128 aa, Homo sapiens
  Payload ID: 10282
  Gene Symbol: MIB2
  Gene Name: mindbomb E3 ubiquitin protein ligase 2
  ENSP ID: ENSP00000426007
MGWKPSEARGQSQSFQASGLQPRSLKAARRATGRPDRSRAARPTMDPSAHRSRAAPPNMDPDPQAGVQASGTPTSSVTAARSTGCGGCAGSAVCAWTTTSARSATCTTSMSSPTPSTATRPLTRALSH

SEQ ID NO: 51648 - protein, 1070 aa, Homo sapiens
  Payload ID: 10282
  Gene Symbol: MIB2
  Gene Name: mindbomb E3 ubiquitin protein ligase 2
  Uniprot ID: Q96AX9
  ENSP ID: ENSP00000426103
MAGALRRGRALGSRPSGPTVSSRRSPQCPVAQEGLGARSRPRVAPRSLARCGPSSRLMGWKPSEARGQSQSFQASGLQPRSLKAARRATGRPDRSRAARPTMDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 51649 - protein, 969 aa, Homo sapiens
  Payload ID: 10282
  Gene Symbol: MIB2
  Gene Name: mindbomb E3 ubiquitin protein ligase 2
  ENSP ID: ENSP00000426128
MDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 51650 - protein, 148 aa, Homo sapiens
  Payload ID: 10282
  Gene Symbol: MIB2
  Gene Name: mindbomb E3 ubiquitin protein ligase 2
  ENSP ID: ENSP00000426603
MDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQG

SEQ ID NO: 51651 - protein, 175 aa, Homo sapiens
  Payload ID: 10282
  Gene Symbol: MIB2
  Gene Name: mindbomb E3 ubiquitin protein ligase 2
  ENSP ID: ENSP00000426865
MDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQD

SEQ ID NO: 51652 - protein, 829 aa, Homo sapiens
  Payload ID: 10282
  Gene Symbol: MIB2
  Gene Name: mindbomb E3 ubiquitin protein ligase 2
  ENSP ID: ENSP00000427680
  MOD_RES (1)..(1): Any amino acid
XCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 51653 - protein, 1005 aa, Homo sapiens
  Payload ID: 10282
  Gene Symbol: MIB2
  Gene Name: mindbomb E3 ubiquitin protein ligase 2
  Uniprot ID: Q96AX9
  ENSP ID: ENSP00000428264
MAGALRRGRALGSRPSGPTVSSRRSPQCPVAQEGLGARSRPRVAPRSLARCGPSSRLMGWKPSEARGQSQSFQASGLQPRSLKAARRATGRPDRSRAARPTMDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 51654 - protein, 1066 aa, Homo sapiens
  Payload ID: 10282
  Gene Symbol: MIB2
  Gene Name: mindbomb E3 ubiquitin protein ligase 2
  Uniprot ID: Q96AX9
  ENSP ID: ENSP00000428660
MAGALRRGRALGSRPSGPTVSSRRSPQCPVAQEGLGARSRPRVAPRSLARCGPSSRLMGWKPSEARGQSQSFQASGLQPRSLKAARRATGRPDRSRAARPTMDPSAHRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPDWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAETGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 51655 - protein, 57 aa, Homo sapiens
  Payload ID: 10282
  Gene Symbol: MIB2
  Gene Name: mindbomb E3 ubiquitin protein ligase 2
  ENSP ID: ENSP00000463504
VHRITDRGDVRVQFNHETRWTFHPGALTKLPRASHLGFTPAQSWLLSAWTLLPWLWG

SEQ ID NO: 51656 - protein, 332 aa, Homo sapiens
  Payload ID: 10282
  Gene Symbol: MIB2
  Gene Name: mindbomb E3 ubiquitin protein ligase 2
  ENSP ID: ENSP00000464106
GRCDVNVRNRKLQSPLHLAVQQAHVGLVPLLVDAGCSVNAEDEEGDTALHVALQRHQLLPLVADGAGGDPGPLQLLSRTWGAGCWGCQVPGDASLGPAPAPALTGVCPAAQLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 51657 - protein, 855 aa, Homo sapiens
  Payload ID: 10283
  Gene Symbol: MCM10
  Gene Name: minichromosome maintenance 10 replication initiation factor
  ENSP ID: ENSP00000367966
MDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPEKSPRPPLKERRVQRIQESTCFSAELDVPALPRTKRVARTPKASPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKKVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKVCHLRTNF

SEQ ID NO: 51658 - protein, 874 aa, Homo sapiens
  Payload ID: 10283
  Gene Symbol: MCM10
  Gene Name: minichromosome maintenance 10 replication initiation factor
  Uniprot ID: Q7L590
  ENSP ID: ENSP00000367986
MDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPEKSPRPPLKERRVQRIQESTCFSAELDVPALPRTKRVARTPKASPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKKVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKEKTGPKIGGETLLPRGEEHAKFLNSLK

SEQ ID NO: 51659 - protein, 69 aa, Homo sapiens
  Payload ID: 10283
  Gene Symbol: MCM10
  Gene Name: minichromosome maintenance 10 replication initiation factor
  ENSP ID: ENSP00000417094
MEDLTDEEEVPASQSTENRVLPAPAPRREKTNEELQEELRNLQEQMKALQEQLKVTTIKQTASPARLQK

SEQ ID NO: 51660 - protein, 875 aa, Homo sapiens
  Payload ID: 10283
  Gene Symbol: MCM10
  Gene Name: minichromosome maintenance 10 replication initiation factor
  Uniprot ID: Q7L590
  ENSP ID: ENSP00000418268
MDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPVEKSPRPPLKERRVQRIQESTCFSAELDVPALPRTKRVARTPKASPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKKVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKEKTGPKIGGETLLPRGEEHAKFLNSLK

SEQ ID NO: 51661 - protein, 824 aa, Homo sapiens
  Payload ID: 10284
  Gene Symbol: MCM8
  Gene Name: minichromosome maintenance 8 homologous recombination repair factor
  Uniprot ID: Q9UJA3
  ENSP ID: ENSP00000265187
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEANSISNSKGQKTKSSEDGCKHGMLMEFSLKDLYAIQEIQAEENLFKLIVNSLCPVIFGHELVKAGLALALFGGSQKYADDKNRIPIRGDPHILVVGDPGLGKSQMLQAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 51662 - protein, 793 aa, Homo sapiens
  Payload ID: 10284
  Gene Symbol: MCM8
  Gene Name: minichromosome maintenance 8 homologous recombination repair factor
  Uniprot ID: Q9UJA3
  ENSP ID: ENSP00000368161
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEGSRNKNDKCMFLLYIEANSISNSKGQKTKSSEDGCKHGMLMEFSLKDLYAIQEIQAEENLFKLIVNSLCPVIFGHEAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 51663 - protein, 880 aa, Homo sapiens
  Payload ID: 10284
  Gene Symbol: MCM8
  Gene Name: minichromosome maintenance 8 homologous recombination repair factor
  Uniprot ID: Q9UJA3
  ENSP ID: ENSP00000368164
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEGSRNKNDKCMFLLYIEANSISNSKGQKTKSSEDGCKHGMLMEFSLKDLYAIQEIQAEENLFKLIVKWSLALSPRLEYSGAISAHCNLHLPSSNSSPTSACRVAGTTGMRHQTQLLLLVKAGLALALFGGSQKYADDKNRIPIRGDPHILVVGDPGLGKSQMLQAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 51664 - protein, 840 aa, Homo sapiens
  Payload ID: 10284
  Gene Symbol: MCM8
  Gene Name: minichromosome maintenance 8 homologous recombination repair factor
  Uniprot ID: Q9UJA3
  ENSP ID: ENSP00000368174
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEGSRNKNDKCMFLLYIEANSISNSKGQKTKSSEDGCKHGMLMEFSLKDLYAIQEIQAEENLFKLIVNSLCPVIFGHELVKAGLALALFGGSQKYADDKNRIPIRGDPHILVVGDPGLGKSQMLQAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 51665 - protein, 840 aa, Homo sapiens; identical to SEQ ID NO: 51664
  Payload ID: 10284
  Gene Symbol: MCM8
  Gene Name: minichromosome maintenance 8 homologous recombination repair factor
  Uniprot ID: Q9UJA3
  ENSP ID: ENSP00000478141

SEQ ID NO: 51666 - protein, 391 aa, Homo sapiens
  Payload ID: 10285
  Gene Symbol: MCM9
  Gene Name: minichromosome maintenance 9 homologous recombination repair factor
  Uniprot ID: Q9NXL9
  ENSP ID: ENSP00000312870
MNSDQVTLVGQVFESYVSEYHKNDILLILKERDEDAHYPVVVNAMTLFETNMEIGEYFNMFPSEVLTIFDSALRRSALTILQSLSQPEAVSMKQNLHARISGLPVCPELVREHIPKTKDVGHFLSVTGTVIRTSLVKVLEFERDYMCNKCKHVFVIKADFEQYYTFCRPSSCPSLESCDSSKFTCLSGLSSSPTRCRDYQEIKIQEQVQRLSVGSIPRSMKVILEDDLVDSCKSGDDLTIYGIVMQRWKPFQQDVRCEVEIVLKANYIQVNNEQSSGIIMDEEVQKEFEDFWEYYKSDPFAGRNVILASLCPQVFGMYLVKLAVAMVLAGGIQRTDATGTRVRGESHLLLVGDPGTGKSQFLKYAAKITPRSVLTTGIGSTSAGIVCDNFK

SEQ ID NO: 51667 - protein, 1143 aa, Homo sapiens
  Payload ID: 10285
  Gene Symbol: MCM9
  Gene Name: minichromosome maintenance 9 homologous recombination repair factor
  Uniprot ID: Q9NXL9
  ENSP ID: ENSP00000314505
MNSDQVTLVGQVFESYVSEYHKNDILLILKERDEDAHYPVVVNAMTLFETNMEIGEYFNMFPSEVLTIFDSALRRSALTILQSLSQPEAVSMKQNLHARISGLPVCPELVREHIPKTKDVGHFLSVTGTVIRTSLVKVLEFERDYMCNKCKHVFVIKADFEQYYTFCRPSSCPSLESCDSSKFTCLSGLSSSPTRCRDYQEIKIQEQVQRLSVGSIPRSMKVILEDDLVDSCKSGDDLTIYGIVMQRWKPFQQDVRCEVEIVLKANYIQVNNEQSSGIIMDEEVQKEFEDFWEYYKSDPFAGRNVILASLCPQVFGMYLVKLAVAMVLAGGIQRTDATGTRVRGESHLLLVGDPGTGKSQFLKYAAKITPRSVLTTGIGSTSAGLTVTAVKDSGEWNLEAGALVLADAGLCCIDEFNSLKEHDRTSIHEAMEQQTISVAKAGLVCKLNTRTTILAATNPKGQYDPQESVSVNIALGSPLLSRFDLILVLLDTKNEDWDRIISSFILENKGYPSKSEKLWSMEKMKTYFCLIRNLQPTLSDVGNQVLLRYYQMQRQSDCRNAARTTIRLLESLIRLAEAHARLMFRDTVTLEDAITVVSVMESSMQGGALLGGVNALHTSFPENPGEQYQRQCELILEKLELQSLLSEELRRLERLQNQSVHQSQPRVLEVETTPGSLRNGPGEESNFRTSSQQEINYSTHIFSPGGSPEGSPVLDPPPHLEPNRSTSRKHSAQHKNNRDDSLDWFDFMATHQSEPKNTVVVSPHPKTSGENMASKISNSTSQGKEKSEPGQRSKVDIGLLPSPGETGVPWRADNVESNKKKRLALDSEAAVSADKPDSVLTHHVPRNLQKLCKERAQKLCRNSTRVPAQCTVPSHPQSTPVHSPDRMLDSPKRKRPKSLAQVEEPAIENVKPPGSPVAKLAKFTFKQKSKLIHSFEDHSHVSPGATKIAVHSPKISQRRTRRDAALPVKRPGKLTSTPGNQISSQPQGETKEVSQQPPEKHGPREKVMCAPEKRIIQPELELGNETGCAHLTCEGDKKEEVSGSNKSGKVHACTLARLANFCFTPPSESKSKSPPPERKNRGERGPSSPPTTTAPMRVSKRKSFQLRGSTEKLIVSKESLFTLPELGDEAFDCDWDEEMRKKS

SEQ ID NO: 51668 - protein, 156 aa, Homo sapiens
  Payload ID: 10285
  Gene Symbol: MCM9
  Gene Name: minichromosome maintenance 9 homologous recombination repair factor
  ENSP ID: ENSP00000394776
MNSDQVTLVGQVFESYVSEYHKNDILLILKERDEDAHYPVVVNAMTLFETNMEIGEYFNMFPSEVLTIFDSALRRSALTILQSLSQPEAVSMKQNLHARISGLPVCPELVREHIPKTKDVGHFLSVTGTVIRTSLVKVLEFERDYMCNKCKHVFVI

SEQ ID NO: 51669 - protein, 183 aa, Homo sapiens
  Payload ID: 10285
  Gene Symbol: MCM9
  Gene Name: minichromosome maintenance 9 homologous recombination repair factor
  ENSP ID: ENSP00000406576
  MOD_RES (1)..(1): Any amino acid
XSLVCKLNTRTTILAATNPKGQYDPQESVSVNIALGSPLLSRFDLILVLLDTKNEDWDRIISSFILENKAHARLMFRDTVTLEDAITVVSVMESSMQGGALLGGVNALHTSFPENPGEQYQRQCELILEKLELQSLLSEELRRLERLQNQSVHQSQPRVLEVETTPGSLRNGPGEESNFRTSS

SEQ ID NO: 51670 - protein, 78 aa, Homo sapiens
  Payload ID: 10285
  Gene Symbol: MCM9
  Gene Name: minichromosome maintenance 9 homologous recombination repair factor
  ENSP ID: ENSP00000426890
MNSDQVTLVGQVFESYVSEYHKNDILLILKERDEDAHYPVVVNAMTLFETNMEIGEYFNMFPSEVLTIFDSALRRSAL

SEQ ID NO: 51671 - protein, 1143 aa, Homo sapiens; identical to SEQ ID NO: 51667
  Payload ID: 10285
  Gene Symbol: MCM9
  Gene Name: minichromosome maintenance 9 homologous recombination repair factor
  Uniprot ID: Q9NXL9
  ENSP ID: ENSP00000480469

SEQ ID NO: 51672 - protein, 642 aa, Homo sapiens
  Payload ID: 10286
  Gene Symbol: MCMBP
  Gene Name: minichromosome maintenance complex binding protein
  Uniprot ID: Q9BTE3
  ENSP ID: ENSP00000353098
MPCGEDWLSHPLGIVQGFFAQNGVNPDWEKKVIEYFKEKLKENNAPKWVPSLNEVPLHYLKPNSFVKFRCMIQDMFDPEFYMGVYETVNQNTKAHVLHFGKYRDVAECGPQQELDLNSPRNTTLERQTFYCVPVPGESTWVKEAYVNANQARVSPSTSYTPSRHKRSYEDDDDMDLQPNKQKDQHAGARQAGSVGGLQWCGEPKRLETEASTGQQLNSLNLSSPFDLNFPLPGEKGPACLVKVYEDWDCFKVNDILELYGILSVDPVLSILNNDERDASALLDPMECTDTAEEQRVHSPPASLVPRIHVILAQKLQHINPLLPACLNKEESKTCKFVSSFMSELSPVRAELLGFLTHALLGDSLAAEYLILHLISTVYTRRDVLPLGKFTVNLSGCPRNSTFTEHLYRIIQHLVPASFRLQMTIENMNHLKFIPHKDYTANRLVSGLLQLPSNTSLVIDETLLEQGQLDTPGVHNVTALSNLITWQKVDYDFSYHQMEFPCNINVFITSEGRSLLPADCQIHLQPQLIPPNMEEYMNSLLSAVLPSVLNKFRIYLTLLRFLEYSISDEITKAVEDDFVEMRKNDPQSITADDLHQLLVVARCLSLSAGQTTLSRERWLRAKQLESLRRTRLQQQKCVNGNEL

SEQ ID NO: 51673 - protein, 640 aa, Homo sapiens
  Payload ID: 10286
  Gene Symbol: MCMBP
  Gene Name: minichromosome maintenance complex binding protein
  Uniprot ID: Q9BTE3
  ENSP ID: ENSP00000358073
MPCGEDWLSHPLGIVQGFFAQNGVNPDWEKKVIEYFKEKLKENNAPKWVPSLNEVPLHYLKPNSFVKFRCMIQDMFDPEFYMGVYETVNQNTKAHVLHFGKYRDVAECGPQQELDLNSPRNTTLERQTFYCVPVPGESTWVKEAYVNANQARVSPSTSYTPSRHKRSYEDDDDMDLQPNKQKDQHAGARQAGSVGGLQWCGEPKRLETEASTGQQLNSLNLSSPFDLNFPLPGEKGPACLVKVYEDWDCFKVNDILELYGILSVDPVLSILNNDERDASALLDPMECTDTAEEQRVHSPPASLVPRIHVILAQKLQHINPLLPACLNKEESKTFVSSFMSELSPVRAELLGFLTHALLGDSLAAEYLILHLISTVYTRRDVLPLGKFTVNLSGCPRNSTFTEHLYRIIQHLVPASFRLQMTIENMNHLKFIPHKDYTANRLVSGLLQLPSNTSLVIDETLLEQGQLDTPGVHNVTALSNLITWQKVDYDFSYHQMEFPCNINVFITSEGRSLLPADCQIHLQPQLIPPNMEEYMNSLLSAVLPSVLNKFRIYLTLLRFLEYSISDEITKAVEDDFVEMRKNDPQSITADDLHQLLVVARCLSLSAGQTTLSRERWLRAKQLESLRRTRLQQQKCVNGNEL

SEQ ID NO: 51674 - protein, 904 aa, Homo sapiens
  Payload ID: 10287
  Gene Symbol: MCM2
  Gene Name: minichromosome maintenance complex component 2
  Uniprot ID: P49736
  ENSP ID: ENSP00000265056
MAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 51675 - protein, 91 aa, Homo sapiens
  Payload ID: 10287
  Gene Symbol: MCM2
  Gene Name: minichromosome maintenance complex component 2
  ENSP ID: ENSP00000417800
  MOD_RES (1)..(1): Any amino acid
XLGTEGPLEEEEDGEELIGDGMERDYRAIPELDAYEAEGLALDDEDVEELTASQREAAERAMRQRDREAGRGLGRMRRGLLYGVSCLPRQR

SEQ ID NO: 51676 - protein, 103 aa, Homo sapiens
  Payload ID: 10287
  Gene Symbol: MCM2
  Gene Name: minichromosome maintenance complex component 2
  ENSP ID: ENSP00000418930
MASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREA

SEQ ID NO: 51677 - protein, 128 aa, Homo sapiens
  Payload ID: 10287
  Gene Symbol: MCM2
  Gene Name: minichromosome maintenance complex component 2
  ENSP ID: ENSP00000419802
MASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLY

SEQ ID NO: 51678 - protein, 146 aa, Homo sapiens
  Payload ID: 10287
  Gene Symbol: MCM2
  Gene Name: minichromosome maintenance complex component 2
  ENSP ID: ENSP00000420007
MAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYGVSCLPRQR

SEQ ID NO: 51679 - protein, 836 aa, Homo sapiens
  Payload ID: 10287
  Gene Symbol: MCM2
  Gene Name: minichromosome maintenance complex component 2
  ENSP ID: ENSP00000420528
  MOD_RES (1)..(1): Any amino acid
XSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKESSRNASLAEAGIGAIPSQLLAIEPSLRRSGVPIGEVGVSQRQEARSFSSANTHWFLEDLLGPSCRDTMIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 51680 - protein, 808 aa, Homo sapiens
  Payload ID: 10288
  Gene Symbol: MCM3
  Gene Name: minichromosome maintenance complex component 3
  Uniprot ID: P25205
  ENSP ID: ENSP00000229854
MAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 51681 - protein, 818 aa, Homo sapiens
  Payload ID: 10288
  Gene Symbol: MCM3
  Gene Name: minichromosome maintenance complex component 3
  ENSP ID: ENSP00000388647
MLICSQGPRLFLEVTFGGGKSSEVFAPGWSHPGNLHATLVEVVLWQRAWRVPWCWTMWSCGRLREITWTSWTTRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 51682 - protein, 328 aa, Homo sapiens
  Payload ID: 10288
  Gene Symbol: MCM3
  Gene Name: minichromosome maintenance complex component 3
  ENSP ID: ENSP00000407651
RYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRDGISPCCPGWSWTPGLKQSFYLSLPKGWDYRHKPLCLFDLILFNDCRVSMVEGIQGGPLGCVPGSSCAVNRHESPHRIHQPGQRRALLFS

SEQ ID NO: 51683 - protein, 77 aa, Homo sapiens
  Payload ID: 10288
  Gene Symbol: MCM3
  Gene Name: minichromosome maintenance complex component 3
  ENSP ID: ENSP00000470057
MLPRSPPLPRGNLWWREEFGSFRAGVESSWEPPRDFGGGSSLAAGMAGTVVLDDVELREAQRDYLDFLDDEASEQCL

SEQ ID NO: 51684 - protein, 853 aa, Homo sapiens
  Payload ID: 10288
  Gene Symbol: MCM3
  Gene Name: minichromosome maintenance complex component 3
  Uniprot ID: P25205
  ENSP ID: ENSP00000472940
MLPRSPPLPRGNLWWREEFGSFRAGVESSWEPPRDFGGGSSLAAGMAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 51685 - protein, 853 aa, Homo sapiens; identical to SEQ ID NO: 51684
  Payload ID: 10288
  Gene Symbol: MCM3
  Gene Name: minichromosome maintenance complex component 3
  Uniprot ID: P25205
  ENSP ID: ENSP00000480987

SEQ ID NO: 51686 - protein, 1980 aa, Homo sapiens
  Payload ID: 10289
  Gene Symbol: MCM3AP
  Gene Name: minichromosome maintenance complex component 3 associated protein
  Uniprot ID: O60318
  ENSP ID: ENSP00000291688
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 51687 - protein, 1980 aa, Homo sapiens; identical to SEQ ID NO: 51686
  Payload ID: 10289
  Gene Symbol: MCM3AP
  Gene Name: minichromosome maintenance complex component 3 associated protein
  Uniprot ID: O60318
  ENSP ID: ENSP00000380820

SEQ ID NO: 51688 - protein, 94 aa, Homo sapiens
  Payload ID: 10289
  Gene Symbol: MCM3AP
  Gene Name: minichromosome maintenance complex component 3 associated protein
  ENSP ID: ENSP00000408934
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFV

SEQ ID NO: 51689 - protein, 863 aa, Homo sapiens
  Payload ID: 10290
  Gene Symbol: MCM4
  Gene Name: minichromosome maintenance complex component 4
  Uniprot ID: P33991
  ENSP ID: ENSP00000262105
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRFDLIFLLLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVEAIDVEEAKRLHREALKQSATDPRTGIVDISILTTGMSATSRKRKEELAEALKKLILSKGKTPALKYQQLFEDIRGQSDIAITKDMFEEALRALADDDFLTVTGKTVRLL

SEQ ID NO: 51690 - protein, 81 aa, Homo sapiens
  Payload ID: 10290
  Gene Symbol: MCM4
  Gene Name: minichromosome maintenance complex component 4
  ENSP ID: ENSP00000427829
MSSPASTPSRRGSRRGRATPAQTPRSEDARSSPSQRRRGEDSTSTGELQPMPTSPGVDLQSPAAQDVLFSSPPQMHSSVHH

SEQ ID NO: 51691 - protein, 278 aa, Homo sapiens
  Payload ID: 10290
  Gene Symbol: MCM4
  Gene Name: minichromosome maintenance complex component 4
  ENSP ID: ENSP00000427875
MAVNEIFFDRYPDSILEHQIQVRPFNALKTKNMRNLNPEDIDQLITISGMVIRTSQLIPEMQEAFFQCQIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQT

SEQ ID NO: 51692 - protein, 211 aa, Homo sapiens
  Payload ID: 10290
  Gene Symbol: MCM4
  Gene Name: minichromosome maintenance complex component 4
  ENSP ID: ENSP00000428833
MPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVR

SEQ ID NO: 51693 - protein, 863 aa, Homo sapiens; identical to SEQ ID NO: 51689
  Payload ID: 10290
  Gene Symbol: MCM4
  Gene Name: minichromosome maintenance complex component 4
  Uniprot ID: P33991
  ENSP ID: ENSP00000430194

SEQ ID NO: 51694 - protein, 140 aa, Homo sapiens
  Payload ID: 10290
  Gene Symbol: MCM4
  Gene Name: minichromosome maintenance complex component 4
  ENSP ID: ENSP00000430329
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIV

SEQ ID NO: 51695 - protein, 27 aa, Homo sapiens
  Payload ID: 10290
  Gene Symbol: MCM4
  Gene Name: minichromosome maintenance complex component 4
  ENSP ID: ENSP00000430864
  MOD_RES (1)..(1): Any amino acid
XENIQLPHTLLSRLAVAGEWFLHTLDS

SEQ ID NO: 51696 - protein, 734 aa, Homo sapiens
  Payload ID: 10291
  Gene Symbol: MCM5
  Gene Name: minichromosome maintenance complex component 5
  Uniprot ID: P33992
  ENSP ID: ENSP00000216122
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 51697 - protein, 691 aa, Homo sapiens
  Payload ID: 10291
  Gene Symbol: MCM5
  Gene Name: minichromosome maintenance complex component 5
  ENSP ID: ENSP00000371441
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 51698 - protein, 230 aa, Homo sapiens
  Payload ID: 10291
  Gene Symbol: MCM5
  Gene Name: minichromosome maintenance complex component 5
  ENSP ID: ENSP00000393977
MSGFDDPGIFYSDSFGGDAQADEGQARKSQLQRRFKEFLRQYRVGTDRTGFTFKYSLAPSLIEHLLPARYCSGCWAAALKLDLAPASRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCN

SEQ ID NO: 51699 - protein, 150 aa, Homo sapiens
  Payload ID: 10291
  Gene Symbol: MCM5
  Gene Name: minichromosome maintenance complex component 5
  ENSP ID: ENSP00000408705
MMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSY

SEQ ID NO: 51700 - protein, 57 aa, Homo sapiens
  Payload ID: 10291
  Gene Symbol: MCM5
  Gene Name: minichromosome maintenance complex component 5
  ENSP ID: ENSP00000412847
MSGFDDPGIFYSDSFGGDAQADEGQARKSQLQRRFKEFLRQYRVGTDRTGFTFKYSS

SEQ ID NO: 51701 - protein, 821 aa, Homo sapiens
  Payload ID: 10292
  Gene Symbol: MCM6
  Gene Name: minichromosome maintenance complex component 6
  Uniprot ID: Q14566
  ENSP ID: ENSP00000264156
MDLAAAAEPGAGSQHLEVRDEVAEKCQKLFLDFLEEFQSSDGEIKYLQLAEELIRPERNTLVVSFVDLEQFNQQLSTTIQEEFYRVYPYLCRALKTFVKDRKEIPLAKDFYVAFQDLPTRHKIRELTSSRIGLLTRISGQVVRTHPVHPELVSGTFLCLDCQTVIRDVEQQFKYTQPNICRNPVCANRRRFLLDTNKSRFVDFQKVRIQETQAELPRGSIPRSLEVILRAEAVESAQAGDKCDFTGTLIVVPDVSKLSTPGARAETNSRVSGVDGYETEGIRGLRALGVRDLSYRLVFLACCVAPTNPRFGGKELRDEEQTAESIKNQMTVKEWEKVFEMSQDKNLYHNLCTSLFPTIHGNDEVKRGVLLMLFGGVPKTTGEGTSLRGDINVCIVGDPSTAKSQFLKHVEEFSPRAVYTSGKASSAAGLTAAVVRDEESHEFVIEAGALMLADNGVCCIDEFDKMDVRDQVAIHEAMEQQTISITKAGVKATLNARTSILAAANPISGHYDRSKSLKQNINLSAPIMSRFDLFFILVDECNEVTDYAIARRIVDLHSRIEESIDRVYSLDDIRRYLLFARQFKPKISKESEDFIVEQYKHLRQRDGSGVTKSSWRITVRQLESMIRLSEAMARMHCCDEVQPKHVKEAFRLLNKSIIRVETPDVNLDQEEEIQMEVDEGAGGINGHADSPAPVNGINGYNEDINQESAPKASLRLGFSEYCRISNLIVLHLRKVEEEEDESALKRSELVNWYLKEIESEIDSEEELINKKRIIEKVIHRLTHYDHVLIELTQAGLKGSTEGSESYEEDPYLVVNPNYLLED

SEQ ID NO: 51702 - protein, 719 aa, Homo sapiens
  Payload ID: 10293
  Gene Symbol: MCM7
  Gene Name: minichromosome maintenance complex component 7
  Uniprot ID: P33993
  ENSP ID: ENSP00000307288
MALKDYALEKEKVKKFLQEFYQDDELGKKQFKYGNQLVRLAHREQVALYVDLDDVAEDDPELVDSICENARRYAKLFADAVQELLPQYKEREVVNKDVLDVYIEHRLMMEQRSRDPGMVRSPQNQYPAELMRRFELYFQGPSSNKPRVIREVRADSVGKLVTVRGIVTRVSEVKPKMVVATYTCDQCGAETYQPIQSPTFMPLIMCPSQECQTNRSGGRLYLQTRGSRFIKFQEMKMQEHSDQVPVGNIPRSITVLVEGENTRIAQPGDHVSVTGIFLPILRTGFRQVVQGLLSETYLEAHRIVKMNKSEDDESGAGELTREELRQIAEEDFYEKLAASIAPEIYGHEDVKKALLLLLVGGVDQSPRGMKIRGNINICLMGDPGVAKSQLLSYIDRLAPRSQYTTGRGSSGVGLTAAVLRDSVSGELTLEGGALVLADQGVCCIDEFDKMAEADRTAIHEVMEQQTISIAKAGILTTLNARCSILAAANPAYGRYNPRRSLEQNIQLPAALLSRFDLLWLIQDRPDRDNDLRLAQHITYVHQHSRQPPSQFEPLDMKLMRRYIAMCREKQPMVPESLADYITAAYVEMRREAWASKDATYTSARTLLAILRLSTALARLRMVDVVEKEDVNEAIRLMEMSKDSLLGDKGQTARTQRPADVIFATVRELVSGGRSVRFSEAEQRCVSRGFTPAQFQAALDEYEELNVWQVNASRTRITFV

SEQ ID NO: 51703 - protein, 389 aa, Homo sapiens
  Payload ID: 10293
  Gene Symbol: MCM7
  Gene Name: minichromosome maintenance complex component 7
  Uniprot ID: P33993
  ENSP ID: ENSP00000344006
MALKDYALEKEKVKKFLQEFYQDDELGKKQFKYGNQLVRLAHREQVALYVDLDDVAEDDPELVDSICENARRYAKLFADAVQELLPQYKEREVVNKDVLDVYIEHRLMMEQRSRDPGMVRSPQNQYPAELMRRFELYFQGPSSNKPRVIREVRADSVGKLVTVRGIVTRVSEVKPKMVVATYTCDQCGAETYQPIQSPTFMPLIMCPSQECQTNRSGGRLYLQTRGSRFIKFQEMKMQEHSDQVPVGNIPRSITVLVEGENTRIAQPGDHVSVTGIFLPILRTGFRQVVQGLLSETYLEAHRIVKMNKSEDDESGAGELTREELRQIADVIFATVRELVSGGRSVRFSEAEQRCVSRGFTPAQFQAALDEYEELNVWQVNASRTRITFV

SEQ ID NO: 51704 - protein, 543 aa, Homo sapiens
  Payload ID: 10293
  Gene Symbol: MCM7
  Gene Name: minichromosome maintenance complex component 7
  Uniprot ID: P33993
  ENSP ID: ENSP00000346171
MVVATYTCDQCGAETYQPIQSPTFMPLIMCPSQECQTNRSGGRLYLQTRGSRFIKFQEMKMQEHSDQVPVGNIPRSITVLVEGENTRIAQPGDHVSVTGIFLPILRTGFRQVVQGLLSETYLEAHRIVKMNKSEDDESGAGELTREELRQIAEEDFYEKLAASIAPEIYGHEDVKKALLLLLVGGVDQSPRGMKIRGNINICLMGDPGVAKSQLLSYIDRLAPRSQYTTGRGSSGVGLTAAVLRDSVSGELTLEGGALVLADQGVCCIDEFDKMAEADRTAIHEVMEQQTISIAKAGILTTLNARCSILAAANPAYGRYNPRRSLEQNIQLPAALLSRFDLLWLIQDRPDRDNDLRLAQHITYVHQHSRQPPSQFEPLDMKLMRRYIAMCREKQPMVPESLADYITAAYVEMRREAWASKDATYTSARTLLAILRLSTALARLRMVDVVEKEDVNEAIRLMEMSKDSLLGDKGQTARTQRPADVIFATVRELVSGGRSVRFSEAEQRCVSRGFTPAQFQAALDEYEELNVWQVNASRTRITFV

SEQ ID NO: 51705 - protein, 183 aa, Homo sapiens
  Payload ID: 10293
  Gene Symbol: MCM7
  Gene Name: minichromosome maintenance complex component 7
  ENSP ID: ENSP00000411295
MMEQRSRDPGMVRSPQNQYPAELMRRFELYFQGPSSNKPRVIREVRADSVGKLVTVRGIVTRVSEVKPKMVVATYTCDQCGAETYQPIQSPTFMPLIMCPSQECQTNRSGGRLYLQTRGSRFIKFQEMKMQEHSDQVPVGNIPRSITVLVEGENTRIAQPGDHVSVTGIFLPILRTGFRQVVQ

SEQ ID NO: 51706 - protein, 83 aa, Homo sapiens
  Payload ID: 10293
  Gene Symbol: MCM7
  Gene Name: minichromosome maintenance complex component 7
  ENSP ID: ENSP00000445904
  MOD_RES (1)..(1): Any amino acid
XEQVALYVDLDDVAEDDPELVDSICENARPSPLPRPAFSPHSMPAAPSWLPPTLPTGATTLAAAWSRTYSYLLHCSPGLTSSG

SEQ ID NO: 51707 - protein, 543 aa, Homo sapiens; identical to SEQ ID NO: 51704
  Payload ID: 10293
  Gene Symbol: MCM7
  Gene Name: minichromosome maintenance complex component 7
  Uniprot ID: P33993
  ENSP ID: ENSP00000483795

SEQ ID NO: 51708 - protein, 632 aa, Homo sapiens
  Payload ID: 10294
  Gene Symbol: MCMDC2
  Gene Name: minichromosome maintenance domain containing 2
  ENSP ID: ENSP00000317234
MSNLKMKEAALIYLDRSGGLQKFIDDCKYYNDSKQSYAVYRFKILINPSDVVELDAELGNHILHQPLKAAEVFQSVCFIAVKTLSLIGQLQTETQINIVLKLTHLPPLPSYGLDLCEFPLDYTSQRFYMMQGIVIAMTTITKYTQGARFLCSDEACPLSKGFQYIRVHVPGATESATIRNDFLCNLCASSLQEDRKFRVLGDKQIVEIIATKALRAFQGYSNNQPFRFQSLTIFLRDESVNKMNIGNEYKIIGIPTCVKTSQTAVCIEANSITFCNSKVPSGISDNFRCLLSLTSSSCWKFTAILANIFASQITPPGTYNLLKLCLLMSLVQTTDRNKELEDCLDILIITSDTLLIDRLLNFSINLVPRGIRHLVSTEIFPTLSRNKYGTGAVSIQAGSALLAKGGICFIGDLASHKKDKLEQLQTVLESRSITVYIPGKKFGEDIDQQMTFPVQCSFWSFVDVDSSSRRNAQKINTLIGQMDCSLIPANLVEAFGLLINCNESSPCHPFLPTVQHTLNKAINPEGLFYAASRQFTTEDFEKLLAFAKNLNVEFSLEAERMTHGYYLASRRIRTGSVCGSKLSASALKYLVFLSEAHARLNLRNKVLKEDVLIAALLFETSLTLKYGNELNY

SEQ ID NO: 51709 - protein, 590 aa, Homo sapiens
  Payload ID: 10294
  Gene Symbol: MCMDC2
  Gene Name: minichromosome maintenance domain containing 2
  Uniprot ID: Q4G0Z9
  ENSP ID: ENSP00000379837
MSNLKMKEAALIYLDRSGGLQKFIDDCKYYNDSKQSYAVYRFKILINPSDVVELDAELGNHILHQPLKAAEVFQSVCFIAVKTLSLIGQLQTETQINIVLKLTHLPPLPSYGLDLCEFPLDYTSQRFYMMQGIVIAMTTITKYTQGARFLCSDEACPLSKGFQYIRVHVPGATESATIRNDFLCNLCASSLQEDRKFRVLGDKQIVEIIATKALRAFQGYSNNQPFRFQSLTIFLRDESVNKMNIGNEYKIIGIPTCVKTSQTAVCIEANSITFCNSKVPSGISDNFRCLLSLTSSSCWKFTAILANIFASQITPPGTYNLLKLCLLMSLVQTTDRNKELEDCLDILIITSDTLLIDRLLNFSINLVPRGIRHLVSTEIFPTLSRNKYGTGAVSIQAGSALLAKGGICFIGDLASHKKDKLEQLQTVLESRSITVYIPGKKFGEDIDQQMTFPVQCSFWSFVDVDSSSRRNAQKINTLIGQMDCSLIPANLVEAFGLLINCNESSPCHPFLPTVQHTLNKAINPEGLFYAASRQFTTEDFEKLLAFAKNLNVEFSLEAERMTHGYYLASRRIRTGSVCGSKLSASALKYL

SEQ ID NO: 51710 - protein, 63 aa, Homo sapiens
  Payload ID: 10294
  Gene Symbol: MCMDC2
  Gene Name: minichromosome maintenance domain containing 2
  ENSP ID: ENSP00000395867
MSNLKMKEAALIYLDRSGGLQKFIDDCKYYNGTFSKDAELGNHILHQPLKAAEVFQSVSQKKK

SEQ ID NO: 51711 - protein, 681 aa, Homo sapiens
  Payload ID: 10294
  Gene Symbol: MCMDC2
  Gene Name: minichromosome maintenance domain containing 2
  Uniprot ID: Q4G0Z9
  ENSP ID: ENSP00000413632
MSNLKMKEAALIYLDRSGGLQKFIDDCKYYNDSKQSYAVYRFKILINPSDVVELDAELGNHILHQPLKAAEVFQSVCFIAVKTLSLIGQLQTETQINIVLKLTHLPPLPSYGLDLCEFPLDYTSQRFYMMQGIVIAMTTITKYTQGARFLCSDEACPLSKGFQYIRVHVPGATESATIRNDFLCNLCASSLQEDRKFRVLGDKQIVEIIATKALRAFQGYSNNQPFRFQSLTIFLRDESVNKMNIGNEYKIIGIPTCVKTSQTAVCIEANSITFCNSKVPSGISDNFRCLLSLTSSSCWKFTAILANIFASQITPPGTYNLLKLCLLMSLVQTTDRNKELEDCLDILIITSDTLLIDRLLNFSINLVPRGIRHLVSTEIFPTLSRNKYGTGAVSIQAGSALLAKGGICFIGDLASHKKDKLEQLQTVLESRSITVYIPGKKFGEDIDQQMTFPVQCSFWSFVDVDSSSRRNAQKINTLIGQMDCSLIPANLVEAFGLLINCNESSPCHPFLPTVQHTLNKAINPEGLFYAASRQFTTEDFEKLLAFAKNLNVEFSLEAERMTHGYYLASRRIRTGSVCGSKLSASALKYLVFLSEAHARLNLRNKVLKEDVLIAALLFETSLTLKYGATVFCVAPNAVFPFELYNEEYLEQRDLYLTQCQQQLEQFIATYGPGTTIFSSDE

SEQ ID NO: 51712 - protein, 42 aa, Homo sapiens
  Payload ID: 10294
  Gene Symbol: MCMDC2
  Gene Name: minichromosome maintenance domain containing 2
  ENSP ID: ENSP00000416848
MSNLKMKEAALIYLDRSGGLQKFIDDCKYYNGTFSKGLFYCC

SEQ ID NO: 51713 - protein, 368 aa, Homo sapiens
  Payload ID: 10294
  Gene Symbol: MCMDC2
  Gene Name: minichromosome maintenance domain containing 2
  ENSP ID: ENSP00000428037
MSNLKMKEAALIYLDRSGGLQKFIDDCKYYNDSKQSYAVYRFKILINPSDVVELDAELGNHILHQPLKAAEVFQSVCFIAVKTLSLIGQLQTETQINIVLKLTHLPPLPSYGLDLCEFPLDYTSQRFYMMQGIVIAMTTITKYTQGARFLCSDEACPLSKGFQYIRVHVPGATESATIRNDFLCNLCASSLQEDRKFRVLGDKQIVEIIATKALRAFQGYSNNQPFRFQSLTIFLRDESVNKMNIGNEYKIIGIPTCVKTSQTAVCIEANSITFCNSKVPSGISDNFRCLLSLTSSSCWKFTAILANIFASQITPPGTYNLLKLCLLMSLVQTTDRNKELEDCLDILIITSDTLLIDRYICDMNFYKY

SEQ ID NO: 51714 - protein, 46 aa, Homo sapiens
  Payload ID: 10295
  Gene Symbol: MINOS1-NBL1
  Gene Name: MINOS1-NBL1 readthrough
  ENSP ID: ENSP00000473256
  MOD_RES (1)..(1): Any amino acid
XKWDRCLADAVVKIEMGFHHVAQAGLELRVQTIHLPWPPNVPGLQA

SEQ ID NO: 51715 - protein, 70 aa, Homo sapiens
  Payload ID: 10295
  Gene Symbol: MINOS1-NBL1
  Gene Name: MINOS1-NBL1 readthrough
  ENSP ID: ENSP00000473403
MFQPLSSPDSHRKGTGFGLGIVFSLTFFKRRMWPLAFGSGMGLGMAYSNCQHDFQAPYLLHGKYVKEQEQ

SEQ ID NO: 51716 - protein, 181 aa, Homo sapiens
  Payload ID: 10295
  Gene Symbol: MINOS1-NBL1
  Gene Name: MINOS1-NBL1 readthrough
  ENSP ID: ENSP00000473411
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 51717 - protein, 71 aa, Homo sapiens
  Payload ID: 10295
  Gene Symbol: MINOS1-NBL1
  Gene Name: MINOS1-NBL1 readthrough
  ENSP ID: ENSP00000473550
RKWDRCLADAVVKIGTGFGLGIVFSLTFFKRRMWPLAFGSGMGLGMAYSNCQHDFQAPYLLHGKYVKEQEQ

SEQ ID NO: 51718 - protein, 442 aa, Homo sapiens
  Payload ID: 10296
  Gene Symbol: MIPOL1
  Gene Name: mirror-image polydactyly 1
  Uniprot ID: Q8TD10
  ENSP ID: ENSP00000333539
MENWSKDITHSYLEQETTGINKSTQPDEQLTMNSEKSMHRKSTELVNEITCENTEWPGQRSTNFQIISSYPDDESVYCTTEKYNVMEHRHNDMHYECMTPCQVTSDSDKEKTIAFLLKELDILRTSNKKLQQKLAKEDKEQRKLKFKLELQEKETEAKIAEKTAALVEEVYFAQKERDEAVMSRLQLAIEERDEAIARAKHMEMSLKVLENINPEENDMTLQELLNRINNADTGIAIQKNGAIIVDRIYKTKECKMRITAEEMSALIEERDAALSKCKRLEQELHHVKEQNQTSANNMRHLTAENNQERALKAKLLSMQQARETAVQQYKKLEEEIQTLRVYYSLHKSLSQEENLKDQFNYTLSTYEEALKNRENIVSITQQQNEELATQLQQALTERANMELQLQHAREASQVANEKVQKLERLVDVLRKKVGTGTMRTVI

SEQ ID NO: 51719 - protein, 442 aa, Homo sapiens; identical to SEQ ID NO: 51718
  Payload ID: 10296
  Gene Symbol: MIPOL1
  Gene Name: mirror-image polydactyly 1
  Uniprot ID: Q8TD10
  ENSP ID: ENSP00000379589

SEQ ID NO: 51720 - protein, 411 aa, Homo sapiens
  Payload ID: 10296
  Gene Symbol: MIPOL1
  Gene Name: mirror-image polydactyly 1
  ENSP ID: ENSP00000438319
MNSEKSMHRKSTELVNEITCENTEWPGQRSTNFQIISSYPDDESVYCTTEKYNVMEHRHNDMHYECMTPCQVTSDSDKEKTIAFLLKELDILRTSNKKLQQKLAKEDKEQRKLKFKLELQEKETEAKIAEKTAALVEEVYFAQKERDEAVMSRLQLAIEERDEAIARAKHMEMSLKVLENINPEENDMTLQELLNRINNADTGIAIQKNGAIIVDRIYKTKECKMRITAEEMSALIEERDAALSKCKRLEQELHHVKEQNQTSANNMRHLTAENNQERALKAKLLSMQQARETAVQQYKKLEEEIQTLRVYYSLHKSLSQEENLKDQFNYTLSTYEEALKNRENIVSITQQQNEELATQLQQALTERANMELQLQHAREASQVANEKVQKLERLVDVLRKKVGTGTMRTVI

SEQ ID NO: 51721 - protein, 424 aa, Homo sapiens
  Payload ID: 10296
  Gene Symbol: MIPOL1
  Gene Name: mirror-image polydactyly 1
  ENSP ID: ENSP00000442529
MNSEKSMHRKSTELVNEITCENTEWPGQRSTNFQIISSYPDDESVYCTTEKYNVMEHRHNDMHYECMTPCQVTSDSDKEKTIAFLLKELDILRTSNKKLQQKLAKEDKEQRKLKFKLELQEKETEAKIAEKTAALVEEVYFAQKERDEAVMSRLQLAIEERDEAIARAKHMEMSLKVLENINPEENDMTLQELLNRINNADTGIAIQKNGAIIVDRIYKTKECKMRITAEEMSALIEERDAALSKCKRLEQELHHVKEQNQTSANNMRHLTAENNQERALKAKLLSMQQARETAVQQYKKLEEEIQTLRVYYSLHKSLSQEENLKDQFNYTLSTYEEALKNRENIVSITQQQNEELATQLQQALTERANMELQLQHAREASQVANEKVQKSQIQIYFIPNKKDEREKFLMDKRRKIVAHSKQNS

SEQ ID NO: 51722 - protein, 442 aa, Homo sapiens; identical to SEQ ID NO: 51718
  Payload ID: 10296
  Gene Symbol: MIPOL1
  Gene Name: mirror-image polydactyly 1
  Uniprot ID: Q8TD10
  ENSP ID: ENSP00000444254

SEQ ID NO: 51723 - protein, 424 aa, Homo sapiens; identical to SEQ ID NO: 51721
  Payload ID: 10296
  Gene Symbol: MIPOL1
  Gene Name: mirror-image polydactyly 1
  ENSP ID: ENSP00000450479

SEQ ID NO: 51724 - protein, 128 aa, Homo sapiens
  Payload ID: 10296
  Gene Symbol: MIPOL1
  Gene Name: mirror-image polydactyly 1
  ENSP ID: ENSP00000450575
MENWSKDITHSYLEQETTGINKSTQPDEQLTMNSEKSMHRKSTELVNEITCENTEWPGQRSTNFQIISSYPDDESVYCTTEKYNVMEHRHNDMHYECMTPCQVTSDSDKEKTIAFLLKELDILRTSNK

SEQ ID NO: 51725 - protein, 104 aa, Homo sapiens
  Payload ID: 10296
  Gene Symbol: MIPOL1
  Gene Name: mirror-image polydactyly 1
  ENSP ID: ENSP00000451297
MENWSKDITHSYLEQETTGINKSTQPDEQLTMNSEKSMHRKSTELVNEITCENTEWPGQRSTNFQIISSYPDDESVYCTTEKYNVMEHRHNDMHYECMTPCQVT

SEQ ID NO: 51726 - protein, 180 aa, Homo sapiens
  Payload ID: 10296
  Gene Symbol: MIPOL1
  Gene Name: mirror-image polydactyly 1
  ENSP ID: ENSP00000452478
MNSEKSMHRKSTELVNEITCENTEWPGQRSTNFQIISSYPDDESVYCTTEKYNVMEHRHNDMHYECMTPCQVTSDSDKEKTIAFLLKELDILRTSNKKLQQKLAKEDKEQRKLKFKLELQEKETEAKIAEKTAGKVVIYATSQRNCSSTVQKTGRGNPDPSSLLQFTQIFISRRKSEGSV

SEQ ID NO: 51727 - protein, 205 aa, Homo sapiens
  Payload ID: 10297
  Gene Symbol: MIS12
  Gene Name: MIS12 kinetochore complex component
  Uniprot ID: Q9H081
  ENSP ID: ENSP00000370557
MSVDPMTYEAQFFGFTPQTCMLRIYIAFQDYLFEVMQAVEQVILKKLDGIPDCDISPVQIRKCTEKFLCFMKGHFDNLFSKMEQLFLQLILRIPSNILLPEDKCKETPYSEEDFQHLQKEIEQLQEKYKTELCTKQALLAELEEQKIVQAKLKQTLTFFDELHNVGRDHGTSDFRESLVSLVQNSRKLQNIRDNVEKESKRLKIS

SEQ ID NO: 51728 - protein, 24 aa, Homo sapiens
  Payload ID: 10297
  Gene Symbol: MIS12
  Gene Name: MIS12 kinetochore complex component
  ENSP ID: ENSP00000459366
MSVDPMTYEAQFFGFTPQTCMLRI

SEQ ID NO: 51729 - protein, 205 aa, Homo sapiens; identical to SEQ ID NO: 51727
  Payload ID: 10297
  Gene Symbol: MIS12
  Gene Name: MIS12 kinetochore complex component
  Uniprot ID: Q9H081
  ENSP ID: ENSP00000461252

SEQ ID NO: 51730 - protein, 125 aa, Homo sapiens
  Payload ID: 10297
  Gene Symbol: MIS12
  Gene Name: MIS12 kinetochore complex component
  ENSP ID: ENSP00000461333
MSVDPMTYEAQFFGFTPQTCMLRIYIAFQDYLFEVMQAVEQVILKKLDGIPDCDISPVQIRKCTEKFLCFMKGHFDNLFSKMEQLFLQLILRIPSNILLPEDKCKETPYSEEDFQHLQKEIEQLQ

SEQ ID NO: 51731 - protein, 205 aa, Homo sapiens; identical to SEQ ID NO: 51727
  Payload ID: 10297
  Gene Symbol: MIS12
  Gene Name: MIS12 kinetochore complex component
  Uniprot ID: Q9H081
  ENSP ID: ENSP00000484532

SEQ ID NO: 51732 - protein, 1132 aa, Homo sapiens
  Payload ID: 10298
  Gene Symbol: MIS18BP1
  Gene Name: MIS18 binding protein 1
  Uniprot ID: Q6P0N0
  ENSP ID: ENSP00000309790
MIATPLKHSRIYLPPEASSQRRNLPMDAIFFDSIPSGTLTPVKDLVKYQNSSLKLNDHKKNQFLKMTTFNNKNIFQSTMLTEATTSNSSLDISAIKPNKDGLKNKANYESPGKIFLRMKEKVLRDKQEQPSRNSSLLEPQKSGNNETFTPNRVEKKKLQHTYLCEEKENNKSFQSDDSSLRASVQGVPLESSNNDIFLPVKQKIQCQQEKKAPLHNLTYELPTLNQEQENFLAVEARNKTLTRAQLAKQIFHSKESIVATTKSKKDTFVLESVDSADEQFQNTNAETLSTNCIPIKNGSLLMVSDSERTTEGTSQQKVKEGNGKTVPGETGLPGSMKDTCKIVLATPRLHITIPRRSKRNISKLSPPRIFQTVTNGLKKNQVVQLQEWMIKSINNNTAICVEGKLIDVTNIYWHSNVIIERIEHNKLRTISGNVYILKGMIDQISMKEAGYPNYLIRKFMFGFPENWKEHIDNFLEQLRAGEKNREKTKQKQKTGRSVRDIRKSMKNDARENQTDTAQRATTTYDFDCDNLELKSNKHSESPGATELNMCHSNCQNKPTLRFPDDQVNNTIQNGGGDDLSNQELIGKKEYKMSSKKLKIGERTNERIIKSQKQETTEELDVSIDILTSREQFFSDEERKYMAINQKKAYILVTPLKSRKVIEQRCMRYNLSAGTIKAVTDFVIPECQKKSPISKSMGTLENTFEGHKSKNKEDCDERDLLTVNRKIKISNLEKEQMLTSDFKKNTRLLPKLKKIENQVAMSFYKHQSSPDLSSEESETEKEIKRKAEVKKTKAGNTKEAVVHLRKSTRNTSNIPVILEPETEESENEFYIKQKKARPSVKETLQKSGVRKEFPITEAVGSDKTNRHPLECLPGLIQDKEWNEKELQKLHCAFASLPKHKPGFWSEVAAAVGSRSPEECQRKYMENPRGKGSQKHVTKKKPANSKGQNGKRGDADQKQTIKITAKVGTLKRKQQMREFLEQLPKDDHDDFFSTTPLQHQRILLPSFQDSEDDDDILPNMDKNPTTPSSVIFPLVKTPQCQHVSPGMLGSINRNDCDKYVFRMQKYHKSNGGIVWGNIKKKLVETDFSTPTPRRKTPFNTDLGENSGIGKLFTNAVESLDEEEKDYYFSNSDSA

SEQ ID NO: 51733 - protein, 155 aa, Homo sapiens
  Payload ID: 10298
  Gene Symbol: MIS18BP1
  Gene Name: MIS18 binding protein 1
  ENSP ID: ENSP00000397184
MIATPLKHSRIYLPPEASSQRRNLPMDAIFFDSIPSGTLTPVKDLVKYQNSSLKLNDHKKNQFLKMTTFNNKNIFQSTMLTEATTSNSSLDISAIKPNKDGLKNKANYESPGKIFLRMKEKVLRDKQEQPSRNSSLLEPQKSGNNETFTPNRVEK

SEQ ID NO: 51734 - protein, 496 aa, Homo sapiens
  Payload ID: 10298
  Gene Symbol: MIS18BP1
  Gene Name: MIS18 binding protein 1
  ENSP ID: ENSP00000398902
MIATPLKHSRIYLPPEASSQRRNLPMDAIFFDSIPSGTLTPVKDLVKYQNSSLKLNDHKKNQFLKMTTFNNKNIFQSTMLTEATTSNSSLDISAIKPNKDGLKNKANYESPGKIFLRMKEKVLRDKQEQPSRNSSLLEPQKSGNNETFTPNRVEKKKLQHTYLCEEKENNKSFQSDDSSLRASVQGVPLESSNNDIFLPVKQKIQCQQEKKAPLHNLTYELPTLNQEQENFLAVEARNKTLTRAQLAKQIFHSKESIVATTKSKKDTFVLESVDSADEQFQNTNAETLSTNCIPIKNGSLLMVSDSERTTEGTSQQKVKEGNGKTVPGETGLPGSMKDTCKIVLATPRLHITIPRRSKRNISKLSPPRIFQTVTNGLKKNQVVQLQEWMIKSINNNTAICVEGKLIDVTNIYWHSNVIIERIEHNKLRTISGNVYILKGMIDQISMKEAGYPNYLIRKFMFGFPENWKEHIDNFLEQLRDGVSSCWPDWSRTPGYK

SEQ ID NO: 51735 - protein, 195 aa, Homo sapiens
  Payload ID: 10298
  Gene Symbol: MIS18BP1
  Gene Name: MIS18 binding protein 1
  ENSP ID: ENSP00000402011
AVEARNKTLTRAQLAKQIFHSKESIVATTKSKKDTFVLESVDSADEQFQNTNAETLSTNCIPIKNGSLLMVSDSERTTEGTSQQKVKEGNGKTVPGETGLPGSMKDTCKIVLATPRLHITIPRRSKRNISKLSPPRIFQTVTNGLKKNQVVQLQEWMIKSINNNTAICVEGKLMISKLSHKEIYVWISRKLERAH

SEQ ID NO: 51736 - protein, 78 aa, Homo sapiens
  Payload ID: 10298
  Gene Symbol: MIS18BP1
  Gene Name: MIS18 binding protein 1
  ENSP ID: ENSP00000451783
  MOD_RES (1)..(1): Any amino acid
XEESENEFYIKQKKARPSVKETLQKSGVRKEFPITEAVGSDKTNRHPLECLPGLIQDKEWNEKELQKLHCTNLVSGQR

SEQ ID NO: 51737 - protein, 496 aa, Homo sapiens; identical to SEQ ID NO: 51734
  Payload ID: 10298
  Gene Symbol: MIS18BP1
  Gene Name: MIS18 binding protein 1
  ENSP ID: ENSP00000487102

SEQ ID NO: 51738 - protein, 233 aa, Homo sapiens
  Payload ID: 10299
  Gene Symbol: MIS18A
  Gene Name: MIS18 kinetochore protein A
  Uniprot ID: Q9NYP9
  ENSP ID: ENSP00000290130
MAGVRSLRCSRGCAGGCECGDKGKCSDSSLLGKRLSEDSSRHQLLQKWASMWSSMSEDASVADMERAQLEEEAAAAEERPLVFLCSGCRRPLGDSLSWVASQEDTNCILLRCVSCNVSVDKEQKLSKREKENGCVLETLCCAGCSLNLGYVYRCTPKNLDYKRDLFCLSVEAIESYVLGSSEKQIVSEDKELFNLESRVEIEKSLTQMEDVLKALQMKLWEAESKLSFATCKS

SEQ ID NO: 51739 - protein, 570 aa, Homo sapiens
  Payload ID: 10300
  Gene Symbol: MSTO1
  Gene Name: misato 1, mitochondrial distribution and morphology regulator
  Uniprot ID: Q9BUK6
  ENSP ID: ENSP00000245564
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAAVESIPVFGALCSSSSLHQTLEALARDLTKLDLRRWASFMDAGVEHDDVAELLQELQSLAQCYQGGDSLVD

SEQ ID NO: 51740 - protein, 524 aa, Homo sapiens
  Payload ID: 10300
  Gene Symbol: MSTO1
  Gene Name: misato 1, mitochondrial distribution and morphology regulator
  Uniprot ID: Q9BUK6
  ENSP ID: ENSP00000357325
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPAVESIPVFGALCSSSSLHQTLEALARDLTKLDLRRWASFMDAGVEHDDVAELLQELQSLAQCYQGGDSLVD

SEQ ID NO: 51741 - protein, 99 aa, Homo sapiens
  Payload ID: 10300
  Gene Symbol: MSTO1
  Gene Name: misato 1, mitochondrial distribution and morphology regulator
  Uniprot ID: Q9BUK6
  ENSP ID: ENSP00000476353
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWEC

SEQ ID NO: 51742 - protein, 78 aa, Homo sapiens
  Payload ID: 10300
  Gene Symbol: MSTO1
  Gene Name: misato 1, mitochondrial distribution and morphology regulator
  ENSP ID: ENSP00000476693
  MOD_RES (1)..(1): Any amino acid
XCHTSQLTPGTPPPSALHACTTGEEILAQYLQQQQPGVMSSSHLLLTPCRVAPPYPHLFSSCSPPGMVLDGSPKGAGM

SEQ ID NO: 51743 - protein, 1303 aa, Homo sapiens
  Payload ID: 10301
  Gene Symbol: MINK1
  Gene Name: misshapen-like kinase 1
  Uniprot ID: Q8N4C8
  ENSP ID: ENSP00000269296
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRASNPDLRRSDPGWERSDSVLPASHGHLPQAGSLERNRVGVSSKPDSSPVLSPGNKAKPDDHRSRPGRPASYKRAIGEDFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 51744 - protein, 1332 aa, Homo sapiens
  Payload ID: 10301
  Gene Symbol: MINK1
  Gene Name: misshapen-like kinase 1
  Uniprot ID: Q8N4C8
  ENSP ID: ENSP00000347427
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRARPRSNSAWQIYLQRRAERGTPKPPGPPAQPPGPPNASSNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 51745 - protein, 1312 aa, Homo sapiens
  Payload ID: 10301
  Gene Symbol: MINK1
  Gene Name: misshapen-like kinase 1
  Uniprot ID: Q8N4C8
  ENSP ID: ENSP00000406487
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLQDQPTRNLAAFPASHDPDPAIPAPTATPSARGAVIRQNSDPTSEGPGPSPNPPAWVRPDNEAPPKVPQRTSSIATALNTSGAGGSRPAQAVRARPRSNSAWQIYLQRRAERGTPKPPGPPAQPPGPPNASSNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 51746 - protein, 161 aa, Homo sapiens
  Payload ID: 10301
  Gene Symbol: MINK1
  Gene Name: misshapen-like kinase 1
  ENSP ID: ENSP00000459102
LPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVGGSFPLKALLSRLP

SEQ ID NO: 51747 - protein, 53 aa, Homo sapiens
  Payload ID: 10301
  Gene Symbol: MINK1
  Gene Name: misshapen-like kinase 1
  ENSP ID: ENSP00000459269
  MOD_RES (1)..(1): Any amino acid
XDLSALRDPAGIFELVEVVGNGTYGQVYKGRHVKTGQLAAIKVMDVTELLPSA

SEQ ID NO: 51748 - protein, 381 aa, Homo sapiens
  Payload ID: 10301
  Gene Symbol: MINK1
  Gene Name: misshapen-like kinase 1
  ENSP ID: ENSP00000459699
  MOD_RES (1)..(1): Any amino acid
XRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYIRHRLEEEQRQLEILQQQLLQEQALLLVTGPSASSGKMLFRASLLERDGNTSREGIHPGHQGNTSPL

SEQ ID NO: 51749 - protein, 111 aa, Homo sapiens
  Payload ID: 10301
  Gene Symbol: MINK1
  Gene Name: misshapen-like kinase 1
  ENSP ID: ENSP00000461500
MGDPAPARSLDDIDLSALRALWFQFFYHSGSSLESPGMLNGPFQHRNSRIMTHRSAEKTLLGSLSLWRWSAMEPTDRCTRVGMSRRGSWLPSRSWMSRRTRRKRSNRRSTC

SEQ ID NO: 51750 - protein, 875 aa, Homo sapiens
  Payload ID: 10302
  Gene Symbol: MIOS
  Gene Name: missing oocyte, meiosis regulator, homolog (Drosophila)
  Uniprot ID: Q9NXC5
  ENSP ID: ENSP00000339881
MSGTKPDILWAPHHVDRFVVCDSELSLYHVESTVNSELKAGSLRLSEDSAATLLSINSDTPYMKCVAWYLNYDPECLLAVGQANGRVVLTSLGQDHNSKFKDLIGKEFVPKHARQCNTLAWNPLDSNWLAAGLDKHRADFSVLIWDICSKYTPDIVPMEKVKLSAGETETTLLVTKPLYELGQNDACLSLCWLPRDQKLLLAGMHRNLAIFDLRNTSQKMFVNTKAVQGVTVDPYFHDRVASFYEGQVAIWDLRKFEKPVLTLTEQPKPLTKVAWCPTRTGLLATLTRDSNIIRLYDMQHTPTPIGDETEPTIIERSVQPCDNYIASFAWHPTSQNRMIVVTPNRTMSDFTVFERISLAWSPITSLMWACGRHLYECTEEENDNSLEKDIATKMRLRALSRYGLDTEQVWRNHILAGNEDPQLKSLWYTLHFMKQYTEDMDQKSPGNKGSLVYAGIKSIVKSSLGMVESSRHNWSGLDKQSDIQNLNEERILALQLCGWIKKGTDVDVGPFLNSLVQEGEWERAAAVALFNLDIRRAIQILNEGASSEKGDLNLNVVAMALSGYTDEKNSLWREMCSTLRLQLNNPYLCVMFAFLTSETGSYDGVLYENKVAVRDRVAFACKFLSDTQLNRYIEKLTNEMKEAGNLEGILLTGLTKDGVDLMESYVDRTGDVQTASYCMLQGSPLDVLKDERVQYWIENYRNLLDAWRFWHKRAEFDIHRSKLDPSSKPLAQVFVSCNFCGKSISYSCSAVPHQGRGFSQYGVSGSPTKSKVTSCPGCRKPLPRCALCLINMGTPVSSCPGGTKSDEKVDLSKDKKLAQFNNWFTWCHNCRHGGHAGHMLSWFRDHAECPVSACTCKCMQLDTTGNLVPAETVQP

SEQ ID NO: 51751 - protein, 875 aa, Homo sapiens; identical to SEQ ID NO: 51750
  Payload ID: 10302
  Gene Symbol: MIOS
  Gene Name: missing oocyte, meiosis regulator, homolog (Drosophila)
  Uniprot ID: Q9NXC5
  ENSP ID: ENSP00000384088

SEQ ID NO: 51752 - protein, 64 aa, Homo sapiens
  Payload ID: 10302
  Gene Symbol: MIOS
  Gene Name: missing oocyte, meiosis regulator, homolog (Drosophila)
  ENSP ID: ENSP00000407518
MSGTKPDILWAPHHVDRFVVCDSELSLYHVESTVNSELKAGSLRLSEDSAATLLSINSDTPYMK

SEQ ID NO: 51753 - protein, 179 aa, Homo sapiens
  Payload ID: 10302
  Gene Symbol: MIOS
  Gene Name: missing oocyte, meiosis regulator, homolog (Drosophila)
  ENSP ID: ENSP00000410752
MSGTKPDILWAPHHVDRFVVCDSELSLYHVESTVNSELKAGSLRLSEDSAATLLSINSDTPYMKCVAWYLNYDPECLLAVGQANGRVVLTSLGQDHNSKFKDLIGKEFVPKHARQCNTLAWNPLDSNWLAAGLDKHRADFSVLIWDICSKYTPDIVPMEKVKLSAGETETTLLVTKPLY

SEQ ID NO: 51754 - protein, 150 aa, Homo sapiens
  Payload ID: 10302
  Gene Symbol: MIOS
  Gene Name: missing oocyte, meiosis regulator, homolog (Drosophila)
  ENSP ID: ENSP00000413050
MSGTKPDILWAPHHVDRFVVCDSELSLYHVESTVNSELKAGSLRLSEDSAATLLSINSDTPYMKCVAWYLNYDPECLLAVGQANGRVVLTSLGQDHNSKFKDLIGKEFVPKHARQCNTLAWNPLDSNWLAAGLDKHRADFSVLIWDICSK

SEQ ID NO: 51755 - protein, 64 aa, Homo sapiens; identical to SEQ ID NO: 51752
  Payload ID: 10302
  Gene Symbol: MIOS
  Gene Name: missing oocyte, meiosis regulator, homolog (Drosophila)
  ENSP ID: ENSP00000413489

SEQ ID NO: 51756 - protein, 249 aa, Homo sapiens
  Payload ID: 10303
  Gene Symbol: MITD1
  Gene Name: MIT, microtubule interacting and transport, domain containing 1
  Uniprot ID: Q8WV92
  ENSP ID: ENSP00000289359
MAKSGLRQDPQSTAAATVLKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQLYNFLRFCEMLIKRPCKVKTIHLLTSLDEGIEQVQQSRGLQEIEESLRSHGVLLEVQYSSSIHDREIRFNNGWMIKIGRGLDYFKKPQSRFSLGYCDFDLRPCHETTVDIFHKKHTKNI

SEQ ID NO: 51757 - protein, 197 aa, Homo sapiens
  Payload ID: 10303
  Gene Symbol: MITD1
  Gene Name: MIT, microtubule interacting and transport, domain containing 1
  ENSP ID: ENSP00000387316
MAKSGLRQDPQSTAAATVLKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQGIEQVQQSRGLQEIEESLRSHGVLLEVQYSSSIHDREIRFNNGWMIKIGRGLDYFKKPQSRFSLGYC

SEQ ID NO: 51758 - protein, 53 aa, Homo sapiens
  Payload ID: 10303
  Gene Symbol: MITD1
  Gene Name: MIT, microtubule interacting and transport, domain containing 1
  ENSP ID: ENSP00000408117
MAKSGLRQDPQSTAAATVLKRAVELDSESRYPQALVCYQEGIDLLLQVLKGEQ

SEQ ID NO: 51759 - protein, 231 aa, Homo sapiens
  Payload ID: 10303
  Gene Symbol: MITD1
  Gene Name: MIT, microtubule interacting and transport, domain containing 1
  ENSP ID: ENSP00000413371
LKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQLYNFLRFCEMLIKRPCKVKTIHLLTSLDEGIEQVQQSRGLQEIEESLRSHGVLLEVQYSSSIHDREIRFNNGWMIKIGRGLDYFKKPQSRFSLGYCDFDLRPCHETTVDIFHKKHTKNI

SEQ ID NO: 51760 - protein, 337 aa, Homo sapiens
  Payload ID: 10304
  Gene Symbol: MARC1
  Gene Name: mitochondrial amidoxime reducing component 1
  Uniprot ID: Q5VT66
  ENSP ID: ENSP00000355877
MGAAGSSALARFVLLAQSRPGWLGVAALGLTAVALGAVAWRRAWPTRRRRLLQQVGTVAQLWIYPVKSCKGVPVSEAECTAMGLRSGNLRDRFWLVINQEGNMVTARQEPRLVLISLTCDGDTLTLSAAYTKDLLLPIKTPTTNAVHKCRVHGLEIEGRDCGEATAQWITSFLKSQPYRLVHFEPHMRPRRPHQIADLFRPKDQIAYSDTSPFLILSEASLADLNSRLEKKVKATNFRPNIVISGCDVYAEDSWDELLIGDVELKRVMACSRCILTTVDPDTGVMSRKEPLETLKSYRQCDPSERKLYGKSPLFGQYFVLENPGTIKVGDPVYLLGQ

SEQ ID NO: 51761 - protein, 263 aa, Homo sapiens
  Payload ID: 10304
  Gene Symbol: MARC1
  Gene Name: mitochondrial amidoxime reducing component 1
  ENSP ID: ENSP00000385327
  MOD_RES (1)..(1): Any amino acid
XFWLVINQEGNMVTARQEPRLVLISLTCDGDTLTLSAAYTKDLLLPIKTPTTNAVHKCRVHGLEIEGRDCGEATAQWITSFLKSQPYRLVHFEPHMRPRRPHQIADLFRPKDQIAYSDTSPFLILSEASLADLNSRLEKKVKATNFRPNIVISGCDVYAEVTLCPFGSFLGFDFFFKDSWDELLIGDVELKRVMACSRCILTTVDPDTGVMSRKEPLETLKSYRQCDPSERKLYGKSPLFGQYFVLENPGTIKVGDPVYLLGQ

SEQ ID NO: 51762 - protein, 119 aa, Homo sapiens
  Payload ID: 10304
  Gene Symbol: MARC1
  Gene Name: mitochondrial amidoxime reducing component 1
  ENSP ID: ENSP00000409634
RPRRPHQIADLFRPKDQIAYSDTSPFLILSEASLADLNSRLEKKVKATNFRPNIVISGCDVYAEDSWDELLIGDVELKRVMACSRCILTTVDPDTGVMSRKEPLETLKRESDVHTDPHG

SEQ ID NO: 51763 - protein, 99 aa, Homo sapiens
  Payload ID: 10304
  Gene Symbol: MARC1
  Gene Name: mitochondrial amidoxime reducing component 1
  ENSP ID: ENSP00000434522
  MOD_RES (1)..(1): Any amino acid
XRPRRPHQIADLFRPKDQIAYSDTSPFLILSEASLADLNSRLEKKVKATNFRPNIVISGCDVYAEVTLCPFGSFLGFDFFFKIYSALNKCRLLCGGYKC

SEQ ID NO: 51764 - protein, 257 aa, Homo sapiens
  Payload ID: 10305
  Gene Symbol: MARC2
  Gene Name: mitochondrial amidoxime reducing component 2
  Uniprot ID: Q969Z3
  ENSP ID: ENSP00000352266
MGASSSSALARLGLPARPWPRWLGVAALGLAAVALGTVAWRRAWPRRRRRLQQVGTVAKLWIYPVKSCKGVPVSEAECTAMGLRSGNLRDRFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEASATRRD

SEQ ID NO: 51765 - protein, 335 aa, Homo sapiens
  Payload ID: 10305
  Gene Symbol: MARC2
  Gene Name: mitochondrial amidoxime reducing component 2
  Uniprot ID: Q969Z3
  ENSP ID: ENSP00000355880
MGASSSSALARLGLPARPWPRWLGVAALGLAAVALGTVAWRRAWPRRRRRLQQVGTVAKLWIYPVKSCKGVPVSEAECTAMGLRSGNLRDRFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEDTWDELLIGSVEVKKVMACPRCILTTVDPDTGVIDRKQPLDTLKSYRLCDPSERELYKLSPLFGIYYSVEKIGSLRVGDPVYRMV

SEQ ID NO: 51766 - protein, 172 aa, Homo sapiens
  Payload ID: 10305
  Gene Symbol: MARC2
  Gene Name: mitochondrial amidoxime reducing component 2
  ENSP ID: ENSP00000416442
GHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEDTWDELLIGSVEVKKVMACPR

SEQ ID NO: 51767 - protein, 94 aa, Homo sapiens
  Payload ID: 10305
  Gene Symbol: MARC2
  Gene Name: mitochondrial amidoxime reducing component 2
  ENSP ID: ENSP00000435450
MGASSSSALARLGLPARPWPRWLGVAALGLAAVALGTVAWRRAWPRRRRRLQQVGTVAKLWIYPVKSCKGVPVSEAECTAMGLRSGNLRDRMCA

SEQ ID NO: 51768 - protein, 540 aa, Homo sapiens
  Payload ID: 10306
  Gene Symbol: MAVS
  Gene Name: mitochondrial antiviral signaling protein
  Uniprot ID: Q7Z434
  ENSP ID: ENSP00000401980
MPFAEDKTYKYICRNFSNFCNVDVVEILPYLPCLTARDQDRLRATCTLSGNRDTLWHLFNTLQRRPGWVEYFIAALRGCELVDLADEVASVYQSYQPRTSDRPPDPLEPPSLPAERPGPPTPAAAHSIPYNSCREKEPSYPMPVQETQAPESPGENSEQALQTLSPRAIPRNPDGGPLESSSDLAALSPLTSSGHQEQDTELGSTHTAGATSSLTPSRGPVSPSVSFQPLARSTPRASRLPGPTGSVVSTGTSFSSSSPGLASAGAAEGKQGAESDQAEPIICSSGAEAPANSLPSKVPTTLMPVNTVALKVPANPASVSTVPSKLPTSSKPPGAVPSNALTNPAPSKLPINSTRAGMVPSKVPTSMVLTKVSASTVPTDGSSRNEETPAAPTPAGATGGSSAWLDSSSENRGLGSELSKPGVLASQVDSPFSGCFEDLAISASTSLGMGPCHGPEENEYKSEGTFGIHVAENPSIQLLEGNPGPPADPDGGPRPQADRKFQEREVPCHRPSPGALWLQVAVTGVLVVTLLVVLYRRRLH

SEQ ID NO: 51769 - protein, 399 aa, Homo sapiens
  Payload ID: 10306
  Gene Symbol: MAVS
  Gene Name: mitochondrial antiviral signaling protein
  Uniprot ID: Q7Z434
  ENSP ID: ENSP00000413749
MPVQETQAPESPGENSEQALQTLSPRAIPRNPDGGPLESSSDLAALSPLTSSGHQEQDTELGSTHTAGATSSLTPSRGPVSPSVSFQPLARSTPRASRLPGPTGSVVSTGTSFSSSSPGLASAGAAEGKQGAESDQAEPIICSSGAEAPANSLPSKVPTTLMPVNTVALKVPANPASVSTVPSKLPTSSKPPGAVPSNALTNPAPSKLPINSTRAGMVPSKVPTSMVLTKVSASTVPTDGSSRNEETPAAPTPAGATGGSSAWLDSSSENRGLGSELSKPGVLASQVDSPFSGCFEDLAISASTSLGMGPCHGPEENEYKSEGTFGIHVAENPSIQLLEGNPGPPADPDGGPRPQADRKFQEREVPCHRPSPGALWLQVAVTGVLVVTLLVVLYRRRLH

SEQ ID NO: 51770 - protein, 234 aa, Homo sapiens
  Payload ID: 10307
  Gene Symbol: MALSU1
  Gene Name: mitochondrial assembly of ribosomal large subunit 1
  Uniprot ID: Q96EH3
  ENSP ID: ENSP00000419370
MGPGGRVARLLAPLMWRRAVSSVAGSAVGAEPGLRLLAVQRLPVGAAFCRACQTPNFVRGLHSEPGLEERAEGTVNEGRPESDAADHTGPKFDIDMMVSLLRQENARDICVIQVPPEMRYTDYFVIVSGTSTRHLHAMAFYVVKMYKHLKCKRDPHVKIEGKDTDDWLCVDFGSMVIHLMLPETREIYELEKLWTLRSYDDQLAQIAPETVPEDFILGIEDDTSSVTPVELKCE

SEQ ID NO: 51771 - protein, 330 aa, Homo sapiens
  Payload ID: 10308
  Gene Symbol: MCU
  Gene Name: mitochondrial calcium uniporter
  Uniprot ID: Q8NE86
  ENSP ID: ENSP00000349680
MAAAAGRSLLLLLSSRGGGGGGAGGCGALTAGCFPGLGVSRHRQQQHHRTVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRVEMGFCHVGQNGFELLTSSYLPASASQSAEIIAVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 51772 - protein, 351 aa, Homo sapiens
  Payload ID: 10308
  Gene Symbol: MCU
  Gene Name: mitochondrial calcium uniporter
  Uniprot ID: Q8NE86
  ENSP ID: ENSP00000362144
MAAAAGRSLLLLLSSRGGGGGGAGGCGALTAGCFPGLGVSRHRQQQHHRTVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERELIERLEDLKEQLAPLEKVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 51773 - protein, 302 aa, Homo sapiens
  Payload ID: 10308
  Gene Symbol: MCU
  Gene Name: mitochondrial calcium uniporter
  Uniprot ID: Q8NE86
  ENSP ID: ENSP00000440913
MVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERELIERLEDLKEQLAPLEKVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 51774 - protein, 101 aa, Homo sapiens
  Payload ID: 10308
  Gene Symbol: MCU
  Gene Name: mitochondrial calcium uniporter
  ENSP ID: ENSP00000473857
MAAAAGRSLLLLLSSRGGGGGGAGGCGALTAGCFPGLGVSRHRQQQHHRTGVEEEVKMWKAQRVGELREGRKQLRSFTTIPTVIGKIPFLPHSPCTMPVTS

SEQ ID NO: 51775 - protein, 88 aa, Homo sapiens
  Payload ID: 10308
  Gene Symbol: MCU
  Gene Name: mitochondrial calcium uniporter
  ENSP ID: ENSP00000473892
MLLGAAPESSPGPRRGRPSSSLVPEGSGRKENQTLFPSVTSSVCVHGEPAPSRWMLHCFRRQASSSWVLKGAFGGPFEGYCISVFTRA

SEQ ID NO: 51776 - protein, 91 aa, Homo sapiens
  Payload ID: 10308
  Gene Symbol: MCU
  Gene Name: mitochondrial calcium uniporter
  ENSP ID: ENSP00000474265
MAAAAGRSLLLLLSSRGGGGGGAGGCGALTAGCFPGLGVSRHRQQQHHRTVFHYHSYSDWQDTVSTSLSMYHASDILAARVWSWPVGVKYW

SEQ ID NO: 51777 - protein, 54 aa, Homo sapiens
  Payload ID: 10308
  Gene Symbol: MCU
  Gene Name: mitochondrial calcium uniporter
  ENSP ID: ENSP00000474820
MAAAAGRSLLLLLSSRGGGGGGAGGCGALTAGCFPGLGVSRHRQQQHHRTVLVM

SEQ ID NO: 51778 - protein, 167 aa, Homo sapiens
  Payload ID: 10308
  Gene Symbol: MCU
  Gene Name: mitochondrial calcium uniporter
  ENSP ID: ENSP00000475141
MSCTRYRAASATKQYTRGSLPGRIWELFIAALLCPLMVNVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERE

SEQ ID NO: 51779 - protein, 359 aa, Homo sapiens
  Payload ID: 10309
  Gene Symbol: MCUR1
  Gene Name: mitochondrial calcium uniporter regulator 1
  Uniprot ID: Q96AQ8
  ENSP ID: ENSP00000368468
MDCGSVGGQRTQRLPGRQRLLFLPVGLSGRPGGSETSARRCLSALSDGLGALRPRAPAARGGVSRASPLLLLLLVPSPRLAAAAPRRQLGDWERSRLGYAAPPAGRSSAWRCSPGVAAAAGALPQYHGPAPALVSCRRELSLSAGSLQLERKRRDFTSSGSRKLYFDTHALVCLLEDNGFATQQAEIIVSALVKILEANMDIVYKDMVTKMQQEITFQQVMSQIANVKKDMIILEKSEFSALRAENEKIKLELHQLKQQVMDEVIKVRTDTKLDFNLEKSRVKELYSLNEKKLLELRTEIVALHAQQDRALTQTDRKIETEVAGLKTMLESHKLDNIKYLAGSIFTCLTVALGFYRLWI

SEQ ID NO: 51780 - protein, 124 aa, Homo sapiens
  Payload ID: 10309
  Gene Symbol: MCUR1
  Gene Name: mitochondrial calcium uniporter regulator 1
  ENSP ID: ENSP00000476106
  MOD_RES (1)..(1): Any amino acid
XKDMIILEKSEFSALRAENEKIKLELHQLKQQVMDEVIKVRTDTKLDFNLEKSRVKELYSLNEKKLLELRTEIVALHAQQDRALTQTDRKIETEVAGLKTMLESHKLDNIKYLAERSPQKRQHT

SEQ ID NO: 51781 - protein, 257 aa, Homo sapiens
  Payload ID: 10309
  Gene Symbol: MCUR1
  Gene Name: mitochondrial calcium uniporter regulator 1
  Uniprot ID: Q96AQ8
  ENSP ID: ENSP00000476162
MDCGSVGGQRTQRLPGRQRLLFLPVGLSGRPGGSETSARRCLSALSDGLGALRPRAPAARGGVSRASPLLLLLLVPSPRLAAAAPRRQLGDWERSRLGYAAPPAGRSSAWRCSPGVAAAAGALPQYHGPAPALVSCRRELSLSAGSLQLERKRRDFTSSGSRKLYFDTHALVCLLEDNESHSFIQAGVQWHSLGLLQPPPPGFKRSSHLILLSSWDYRHAPPHLDNFSVFLLETGFHHVGQAGLKLLTSSDPPTLAS

SEQ ID NO: 51782 - protein, 476 aa, Homo sapiens
  Payload ID: 10310
  Gene Symbol: MICU1
  Gene Name: mitochondrial calcium uptake 1
  Uniprot ID: Q9BPX6
  ENSP ID: ENSP00000354415
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 51783 - protein, 478 aa, Homo sapiens [sequence omitted]

SEQ ID NO: 51784 - protein, 278 aa, Homo sapiens
  Payload ID: 10310
  Gene Symbol: MICU1
  Gene Name: mitochondrial calcium uptake 1
  Uniprot ID: Q9BPX6
  ENSP ID: ENSP00000381747
MVSLKAKLNHLRQSMLKQKAPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 51785 - protein, 278 aa, Homo sapiens
  Payload ID: 10310
  Gene Symbol: MICU1
  Gene Name: mitochondrial calcium uptake 1
  Uniprot ID: Q9BPX6
  ENSP ID: ENSP00000402470
MKRIYTYRRAKEIFKDTPKAPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 51786 - protein, 246 aa, Homo sapiens
  Payload ID: 10310
  Gene Symbol: MICU1
  Gene Name: mitochondrial calcium uptake 1
  ENSP ID: ENSP00000432492
  MOD_RES (1)..(1): Any amino acid
XNEKQPEHLGLDQYIIKRFDGKKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKGKGTIFMGRR

SEQ ID NO: 51787 - protein, 212 aa, Homo sapiens
  Payload ID: 10310
  Gene Symbol: MICU1
  Gene Name: mitochondrial calcium uptake 1
  ENSP ID: ENSP00000474192
MVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKKISQEREKFADEGSIFYTLGECGLISFSDYIFLTTVLSTPQRNFEIAFKMFDLNGDGEVDMEEFEQA

SEQ ID NO: 51788 - protein, 388 aa, Homo sapiens
  Payload ID: 10310
  Gene Symbol: MICU1
  Gene Name: mitochondrial calcium uptake 1
  ENSP ID: ENSP00000474775
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKARFSKKKILHRVRKKSKGSILQRRKKALQKEERTRHGSTKHNEQEVRRTIMEWLEKAGVQWHHLSSLQPPTPWFKRFFCLSLLSSWDYRHTPPCPANFFIFSRDRVSPCWPGWSRYPDLMIRPPWLRKVLGLQKISQEREKFADEGSIFYTLGECGLISFSDYIFLTTVLSTPQRNFEIAFKMFDLNGDGEVDMEEFEQVQSIIRSQTS

SEQ ID NO: 51789 - protein, 154 aa, Homo sapiens
  Payload ID: 10310
  Gene Symbol: MICU1
  Gene Name: mitochondrial calcium uptake 1
  ENSP ID: ENSP00000474809
MKRIYTYRRAKEIFKDTPKAPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKH

SEQ ID NO: 51790 - protein, 480 aa, Homo sapiens
  Payload ID: 10310
  Gene Symbol: MICU1
  Gene Name: mitochondrial calcium uptake 1
  ENSP ID: ENSP00000489563
MFRLNSLSALAELAVGSRWYHGGSQPIQIRRRLMMVAFLGASAVTASTGLLWKRAHAESPPCVDNLKSDIGDKGKNKDEGDVCNHEKKTADLAPHPEEKKKKRSGFRDRKVMEYENRIRAYSTPDKIFRYFATLKVISEPGEAEVFMTPEDFVRSITPNEKQPEHLGLDQYIIKRFDGKDFWQKISQEREKFADEGSIFYTLGECGLISFSDYIFLTTVLSTPQRNFEIAFKMFDLNGDGEVDMEEFEQVQSIIRSQTSMGMRHRDRPTTGNTLKSGLCSALTTYFFGADLKGKLTIKNFLEFQRKLQHDVLKLEFERHDPVDGRITERQFGGMLLAYSGVQSKKLTAMQRQLKKHFKEGKGLTFQEVENFFTFLKNINDVDTALSFYHMAGASLDKVTMQQVARTVAKVELSDHVCDVVFALFDCDGNGELSNKEFVSIMKQRLMRGLEKPKDMGFTRLMQAMWKCAQETAWDFALPKQ

SEQ ID NO: 51791 - protein, 434 aa, Homo sapiens
  Payload ID: 10311
  Gene Symbol: MICU2
  Gene Name: mitochondrial calcium uptake 2
  Uniprot ID: Q8IYU8
  ENSP ID: ENSP00000371811
MAAAAGSCARVAAWGGKLRRGLAVSRQAVRSPGPLAAAVAGAALAGAGAAWHHSRVSVAARDGSFTVSAQKNVEHGIIYIGKPSLRKQRFMQFSSLEHEGEYYMTPRDFLFSVMFEQMERKTSVKKLTKKDIEDTLSGIQTAGCGSTFFRDLGDKGLISYTEYLFLLTILTKPHSGFHVAFKMLDTDGNEMIEKREFFKLQKIISKQDDLMTVKTNETGYQEAIVKEPEINTTLQMRFFGKRGQRKLHYKEFRRFMENLQTEIQEMEFLQFSKGLSFMRKEDFAEWLLFFTNTENKDIYWKNVREKLSAGESISLDEFKSFCHFTTHLEDFAIAMQMFSLAHRPVRLAEFKRAVKVATGQELSNNILDTVFKIFDLDGDECLSHEEFLGVLKNRMHRGLWVPQHQSIQEYWKCVKKESIKGVKEVWKQAGKGLF

SEQ ID NO: 51792 - protein, 236 aa, Homo sapiens
  Payload ID: 10311
  Gene Symbol: MICU2
  Gene Name: mitochondrial calcium uptake 2
  ENSP ID: ENSP00000431792
MAAAAGSCARVAAWGGKLRRGLAVSRQAVRSPGPLAAAVAGAALAGAGAAWHHSRVSVAARDGSFTVSAQKNVEHGIIYIGKPSLRKQRFMQFSSLEHEGEYYMTPRDFLFSVMFEQMERKTSVKKLTKKDIEDTLSGIQTAGCGSTFFRDLGDKGLISYTEYLFLLTILTKPHSGFHVAFKMLDTDGNEMIEKREFFKIDTIDSERQLQKIISKQDDLMTVKTNETGYQEAIVKE

SEQ ID NO: 51793 - protein, 530 aa, Homo sapiens
  Payload ID: 10312
  Gene Symbol: MICU3
  Gene Name: mitochondrial calcium uptake family, member 3
  Uniprot ID: Q86XE3
  ENSP ID: ENSP00000321455
MAALRRLLWPPPRVSPPLCAHQPLLGPWGRPAVTTLGLPGRPFSSREDEERAVAEAAWRRRRRWGELSVAAAAGGGLVGLVCYQLYGDPRAGSPATGRPSKSAATEPEDPPRGRGMLPIPVAAAKETVAIGRTDIEDLDLYATSRERRFRLFASIECEGQLFMTPYDFILAVTTDEPKVAKTWKSLSKQELNQMLAETPPVWKGSSKLFRNLKEKGVISYTEYLFLLCILTKPHAGFRIAFNMFDTDGNEMVDKKEFLVLQEIFRKKNEKREIKGDEEKRAMLRLQLYGYHSPTNSVLKTDAEELVSRSYWDTLRRNTSQALFSDLAERADDITSLVTDTTLLVHFFGKKGKAELNFEDFYRFMDNLQTEVLEIEFLSYSNGMNTISEEDFAHILLRYTNVENTSVFLENVRYSIPEEKGITFDEFRSFFQFLNNLEDFAIALNMYNFASRSIGQDEFKRAVYVATGLKFSPHLVNTVFKIFDVDKDDQLSYKEFIGIMKDRLHRGFRGYKTVQKYPTFKSCLKKELHSR

SEQ ID NO: 51794 - protein, 375 aa, Homo sapiens
  Payload ID: 10312
  Gene Symbol: MICU3
  Gene Name: mitochondrial calcium uptake family, member 3
  ENSP ID: ENSP00000427765
  MOD_RES (1)..(1): Any amino acid
XSRERRFRLFASIECEGQLFMTPYDFILAVTTDEPKVAKTWKSLSKQELNQMLAETPPVWKGSSKLFRNLKEKGVISYTEYLFLLCILTKPHAGFRIAFNMFDTDGNEMVDKKEFLVLQEIFRKKNEKREIKGDEEKRAMLVLKTDAEELVSRSYWDTLRRNTSQALFSDLAERADDITSLVTDTTLLVHFFGKKGKAELNFEDFYRFMDNLQTEVLEIEFLSYSNGMNTISEEDFAHILLRYTNVENTSVFLENVRYSIPEEKGITFDEFRSFFQFLNNLEDFAIALNMYNFASRSIGQDEFKRAVYVATGLKFSPHLVNTVFKIFDVDKDDQLSYKEFIGIMKDRLHRGFRGYKTVQKYPTFKSCLKKELHSR

SEQ ID NO: 51795 - protein, 100 aa, Homo sapiens
  Payload ID: 10312
  Gene Symbol: MICU3
  Gene Name: mitochondrial calcium uptake family, member 3
  ENSP ID: ENSP00000428890
  MOD_RES (1)..(1): Any amino acid
XFMTPYDFILAVTTDEPKVAKTWKSLSKQELNQMLAETPPVWKGSSKLFRNLKEKGVISYTEYLFLLCILTSKYTYCFYFWMQLYFLNESWKADLRFSYS

SEQ ID NO: 51796 - protein, 372 aa, Homo sapiens
  Payload ID: 10313
  Gene Symbol: MTCH1
  Gene Name: mitochondrial carrier 1
  Uniprot ID: Q9NZJ7
  ENSP ID: ENSP00000362718
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 51797 - protein, 389 aa, Homo sapiens
  Payload ID: 10313
  Gene Symbol: MTCH1
  Gene Name: mitochondrial carrier 1
  Uniprot ID: Q9NZJ7
  ENSP ID: ENSP00000362730
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 51798 - protein, 201 aa, Homo sapiens
  Payload ID: 10313
  Gene Symbol: MTCH1
  Gene Name: mitochondrial carrier 1
  ENSP ID: ENSP00000399187
  MOD_RES (1)..(1): Any amino acid
XAVCVPHVGPPPACHLNALHGPVCGTGGQVQLSCGATIPGSSAAMVPHFGVINGKLAHSPRLIMSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSLLFRRVSSGSCFA

SEQ ID NO: 51799 - protein, 394 aa, Homo sapiens
  Payload ID: 10313
  Gene Symbol: MTCH1
  Gene Name: mitochondrial carrier 1
  ENSP ID: ENSP00000419739
AGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQVSKHWTAEAFPVLCYILQLKWFCGCFIACKDKWFHGIQYCEEILGIYKAFKFSSYIISERI

SEQ ID NO: 51800 - protein, 363 aa, Homo sapiens
  Payload ID: 10313
  Gene Symbol: MTCH1
  Gene Name: mitochondrial carrier 1
  ENSP ID: ENSP00000437660
MDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSFSQALAIRSYTKFVMGIAVSMLTYPFLLVGDLMAVNNCGLQAGLPPYSPVFKSWIHCWKYLSVQGQLFRGSSCFSAGCHQDHALPWSNLNHLKNTVSTWPPWVRPDHLGTPARRLQPNNNQMCSSPAGLQFHICHVSVQMWG

SEQ ID NO: 51801 - protein, 303 aa, Homo sapiens
  Payload ID: 10314
  Gene Symbol: MTCH2
  Gene Name: mitochondrial carrier 2
  Uniprot ID: Q9Y6C9
  ENSP ID: ENSP00000303222
MADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 51802 - protein, 262 aa, Homo sapiens
  Payload ID: 10314
  Gene Symbol: MTCH2
  Gene Name: mitochondrial carrier 2
  ENSP ID: ENSP00000432043
MADAASQVLLGSGLTILSQPLMYVKVLIQVGYEPLPPTIGRNIFGRQVCQLPGLFSYAQHIASIDGRRGLFTGLTPRLCSGVLGTVVHGKVLQELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCM

SEQ ID NO: 51803 - protein, 119 aa, Homo sapiens
  Payload ID: 10315
  Gene Symbol: MCCD1
  Gene Name: mitochondrial coiled-coil domain 1
  Uniprot ID: P59942
  ENSP ID: ENSP00000365362
MVLPLPWLSRYHFLRLLLPSWSLAPQGSHGCCSQNPKASMEEQTSSRGNGKMTSPPRGPGTHRTAELARAEELLEQQLELYQALLEGQEGAWEAQALVLKIQKLKEQMRRHQESLGGGA

SEQ ID NO: 51804 - protein, 119 aa, Homo sapiens
  Payload ID: 10315
  Gene Symbol: MCCD1
  Gene Name: mitochondrial coiled-coil domain 1
  Uniprot ID: P59942
  ENSP ID: ENSP00000373004
MVLPLPWLSRYHFLRLLLPSWSLAPQGSHGCCSQNPKASMEEQTNSRGNGKMTSPPRGPGTHRTAELARAEELLEQQLELYQALLEGQEGAWEAQALVLKIQKLKEQMRRHQESLGGGA

SEQ ID NO: 51805 - protein, 119 aa, Homo sapiens; identical to SEQ ID NO: 51804
  Payload ID: 10315
  Gene Symbol: MCCD1
  Gene Name: mitochondrial coiled-coil domain 1
  Uniprot ID: P59942
  ENSP ID: ENSP00000389666

SEQ ID NO: 51806 - protein, 119 aa, Homo sapiens; identical to SEQ ID NO: 51804
  Payload ID: 10315
  Gene Symbol: MCCD1
  Gene Name: mitochondrial coiled-coil domain 1
  Uniprot ID: P59942
  ENSP ID: ENSP00000392250

SEQ ID NO: 51807 - protein, 119 aa, Homo sapiens; identical to SEQ ID NO: 51803
  Payload ID: 10315
  Gene Symbol: MCCD1
  Gene Name: mitochondrial coiled-coil domain 1
  Uniprot ID: P59942
  ENSP ID: ENSP00000399197

SEQ ID NO: 51808 - protein, 119 aa, Homo sapiens; identical to SEQ ID NO: 51804
  Payload ID: 10315
  Gene Symbol: MCCD1
  Gene Name: mitochondrial coiled-coil domain 1
  Uniprot ID: P59942
  ENSP ID: ENSP00000402555

SEQ ID NO: 51809 - protein, 119 aa, Homo sapiens; identical to SEQ ID NO: 51803
  Payload ID: 10315
  Gene Symbol: MCCD1
  Gene Name: mitochondrial coiled-coil domain 1
  Uniprot ID: P59942
  ENSP ID: ENSP00000407020

SEQ ID NO: 51810 - protein, 119 aa, Homo sapiens [sequence omitted]

SEQ ID NO: 51811 - protein, 352 aa, Homo sapiens
  Payload ID: 10316
  Gene Symbol: MUL1
  Gene Name: mitochondrial E3 ubiquitin protein ligase 1
  Uniprot ID: Q969V5
  ENSP ID: ENSP00000264198
MESGGRPSLCQFILLGTTSVVTAALYSVYRQKARVSQELKGAKKVHLGEDLKSILSEAPGKCVPYAVIEGAVRSVKETLNSQFVENCKGVIQRLTLQEHKMVWNRTTHLWNDCSKIIHQRTNTVPFDLVPHEDGVDVAVRVLKPLDSVDLGLETVYEKFHPSIQSFTDVIGHYISGERPKGIQETEEMLKVGATLTGVGELVLDNNSVRLQPPKQGMQYYLSSQDFDSLLQRQESSVRLWKVLALVFGFATCATLFFILRKQYLQRQERLRLKQMQEEFQEHEAQLLSRAKPEDRESLKSACVVCLSSFKSCVFLECGHVCSCTECYRALPEPKKCPICRQAITRVIPLYNS

SEQ ID NO: 51812 - protein, 463 aa, Homo sapiens
  Payload ID: 10317
  Gene Symbol: MIEF1
  Gene Name: mitochondrial elongation factor 1
  Uniprot ID: Q9NQG6
  ENSP ID: ENSP00000327124
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTDTFCPPRPKPVARKGQVDLKKSRLRMSLQEKLLTYYRNRAAIPAGEQARAKQAAVDICAELRSFLRAKLPDMPLRDMYLSGSLYDDLQVVTADHIQLIVPLVLEQNLWSCIPGEDTIMNVPGFFLVRRENPEYFPRGSSYWDRCVVGGYLSPKTVADTFEKVVAGSINWPAIGSLLDYVIRPAPPPEALTLEVQYERDKHLFIDFLPSVTLGDTVLVAKPHRLAQYDNLWRLSLRPAETARLRALDQADSGCRSLCLKILKAICKSTPALGHLTASQLTNVILHLAQEEADWSPDMLADRFLQALRGLISYLEAGVLPSALNPKVNLFAELTPEEIDELGYTLYCSLSEPEVLLQT

SEQ ID NO: 51813 - protein, 478 aa, Homo sapiens
  Payload ID: 10317
  Gene Symbol: MIEF1
  Gene Name: mitochondrial elongation factor 1
  ENSP ID: ENSP00000385110
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTDTFCPPRPKPVARKGQVDLKKSRLRMSLQEKLLTYYRNRAAIPAGEQARAKQAAVDICAELRSFLRAKLPDMPLRDMYLSGSLYDDLQVVTADHIQLIVPLVLEQNLWSCIPGEDTIMNVPGFFLVRRENPEYFPRGSSYWDRCVVGGYLSPKTVADTFEKVVAGSINWPAIGSLLDYVIRPAPPPEALTLEVQYERDKHLFIDFLPSVTLGDTVLVAKPHRLAQYDNLWRLSLRPAETARLRALDQADSGCRSLCLKILKAICKSTPALGHLTASQLTNVILHLAQEEADWSPDMLADRFLQALRGLISYLEAGVLPSALNPKDKALKERSLRHQVRMMEVDSRLNVSWKIQSLVGVWWPCFLPRQALLF

SEQ ID NO: 51814 - protein, 463 aa, Homo sapiens; identical to SEQ ID NO: 51812
  Payload ID: 10317
  Gene Symbol: MIEF1
  Gene Name: mitochondrial elongation factor 1
  Uniprot ID: Q9NQG6
  ENSP ID: ENSP00000385191

SEQ ID NO: 51815 - protein, 42 aa, Homo sapiens
  Payload ID: 10317
  Gene Symbol: MIEF1
  Gene Name: mitochondrial elongation factor 1
  ENSP ID: ENSP00000390029
MAGAGERKGKKDDNGIGTAIDFVLSNARLVLGVGGAAMLGIA

SEQ ID NO: 51816 - protein, 148 aa, Homo sapiens
  Payload ID: 10317
  Gene Symbol: MIEF1
  Gene Name: mitochondrial elongation factor 1
  Uniprot ID: Q9NQG6
  ENSP ID: ENSP00000404096
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTGETSYLLPEPGSHPCWRAGSGQASCCGHMCRAPELPAGQVA

SEQ ID NO: 51817 - protein, 148 aa, Homo sapiens; identical to SEQ ID NO: 51816
  Payload ID: 10317
  Gene Symbol: MIEF1
  Gene Name: mitochondrial elongation factor 1
  Uniprot ID: Q9NQG6
  ENSP ID: ENSP00000413730

SEQ ID NO: 51818 - protein, 454 aa, Homo sapiens
  Payload ID: 10318
  Gene Symbol: MIEF2
  Gene Name: mitochondrial elongation factor 2
  Uniprot ID: Q96C03
  ENSP ID: ENSP00000323591
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPEGPAETDPEVTPQLSSPAPLCLTLQERLLAFERDRVTIPAAQVALAKQLAGDIALELQAYFRSKFPELPFGAFVPGGPLYDGLQAGAADHVRLLVPLVLEPGLWSLVPGVDTVARDPRCWAVRRTQLEFCPRGSSPWDRFLVGGYLSSRVLLELLRKALAASVNWPAIGSLLGCLIRPSMASEELLLEVQHERLELTVAVLVAVPGVDADDRLLLAWPLEGLAGNLWLQDLYPVEAARLRALDDHDAGTRRRLLLLLCAVCRGCSALGQLGRGHLTQVVLRLGEDNVDWTEEALGERFLQALELLIGSLEQASLPCHFNPSVNLFSSLREEEIDDIGYALYSGLQEPEGLL

SEQ ID NO: 51819 - protein, 163 aa, Homo sapiens
  Payload ID: 10318
  Gene Symbol: MIEF2
  Gene Name: mitochondrial elongation factor 2
  ENSP ID: ENSP00000379055
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPGEWHSFPSFGVTFKRRSPGFALTDCVTLRESLLLSRLWAPQIFNGGGVSLPCSWSKVVAL

SEQ ID NO: 51820 - protein, 205 aa, Homo sapiens
  Payload ID: 10318
  Gene Symbol: MIEF2
  Gene Name: mitochondrial elongation factor 2
  Uniprot ID: Q96C03
  ENSP ID: ENSP00000379056
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPGEAAGLRAGPCDHPSSPGGFGQTAGWRHRPGAAGLLSEQVPGTALWGIRAWGAALRRAAGGGCGPCASPGATGAGAGPVEPGAGRGHCGEGPSLLGRAQDAA

SEQ ID NO: 51821 - protein, 465 aa, Homo sapiens
  Payload ID: 10318
  Gene Symbol: MIEF2
  Gene Name: mitochondrial elongation factor 2
  Uniprot ID: Q96C03
  ENSP ID: ENSP00000379057
MGLSPNLDRQTMAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPEGPAETDPEVTPQLSSPAPLCLTLQERLLAFERDRVTIPAAQVALAKQLAGDIALELQAYFRSKFPELPFGAFVPGGPLYDGLQAGAADHVRLLVPLVLEPGLWSLVPGVDTVARDPRCWAVRRTQLEFCPRGSSPWDRFLVGGYLSSRVLLELLRKALAASVNWPAIGSLLGCLIRPSMASEELLLEVQHERLELTVAVLVAVPGVDADDRLLLAWPLEGLAGNLWLQDLYPVEAARLRALDDHDAGTRRRLLLLLCAVCRGCSALGQLGRGHLTQVVLRLGEDNVDWTEEALGERFLQALELLIGSLEQASLPCHFNPSVNLFSSLREEEIDDIGYALYSGLQEPEGLL

SEQ ID NO: 51822 - protein, 117 aa, Homo sapiens
  Payload ID: 10318
  Gene Symbol: MIEF2
  Gene Name: mitochondrial elongation factor 2
  ENSP ID: ENSP00000463015
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPGGSVVMVGSFRWGN

SEQ ID NO: 51823 - protein, 121 aa, Homo sapiens
  Payload ID: 10318
  Gene Symbol: MIEF2
  Gene Name: mitochondrial elongation factor 2
  ENSP ID: ENSP00000464017
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPGCSDMFPAPSLCRRACRN

SEQ ID NO: 51824 - protein, 159 aa, Homo sapiens
  Payload ID: 10318
  Gene Symbol: MIEF2
  Gene Name: mitochondrial elongation factor 2
  ENSP ID: ENSP00000465801
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPGPAETDPEVTPQLSSPAPLCLTLQERLLAFERDRVTIPAAQVALAKQLAGDIALEL

SEQ ID NO: 51825 - protein, 342 aa, Homo sapiens
  Payload ID: 10319
  Gene Symbol: MFF
  Gene Name: mitochondrial fission factor
  Uniprot ID: Q9GZY8
  ENSP ID: ENSP00000302037
MSKGTSSDTSLGRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 51826 - protein, 238 aa, Homo sapiens
  Payload ID: 10319
  Gene Symbol: MFF
  Gene Name: mitochondrial fission factor
  Uniprot ID: Q9GZY8
  ENSP ID: ENSP00000304134
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 51827 - protein, 291 aa, Homo sapiens
  Payload ID: 10319
  Gene Symbol: MFF
  Gene Name: mitochondrial fission factor
  Uniprot ID: Q9GZY8
  ENSP ID: ENSP00000304898
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 51828 - protein, 243 aa, Homo sapiens
  Payload ID: 10319
  Gene Symbol: MFF
  Gene Name: mitochondrial fission factor
  Uniprot ID: Q9GZY8
  ENSP ID: ENSP00000338412
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTYGISNIDTTIEGTSDDLTVVDAASLRRQIIKLNRRLQLLEEENKERAKREMVMYSITVAFWLLNSWLWFRR

SEQ ID NO: 51829 - protein, 218 aa, Homo sapiens
  Payload ID: 10319
  Gene Symbol: MFF
  Gene Name: mitochondrial fission factor
  Uniprot ID: Q9GZY8
  ENSP ID: ENSP00000346498
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLYGISNIDTTIEGTSDDLTVVDAASLRRQIIKLNRRLQLLEEENKERAKREMVMYSITVAFWLLNSWLWFRR

SEQ ID NO: 51830 - protein, 221 aa, Homo sapiens
  Payload ID: 10319
  Gene Symbol: MFF
  Gene Name: mitochondrial fission factor
  ENSP ID: ENSP00000375912
MQVPERIVVAGNNEDVSFSRPADLDLIQSTPFKPLALKTPPRVLTLSERPLDFLDLERPPTTPQNEEIRAVGRLKRERSMSENAVRQNGQLVRNDSLVTPSPQQARVCPPHMLPEDGANLSSARGILSLIQSSTRRAYQQILDVLDENRRYGISNIDTTIEGTSDDLTVVDAASLRRQIIKLNRRLQLLEEENKERAKREMVMYSITVAFWLLNSWLWFRR

SEQ ID NO: 51831 - protein, 238 aa, Homo sapiens; identical to SEQ ID NO: 51826
  Payload ID: 10319
  Gene Symbol: MFF
  Gene Name: mitochondrial fission factor
  Uniprot ID: Q9GZY8
  ENSP ID: ENSP00000386641

SEQ ID NO: 51832 - protein, 218 aa, Homo sapiens; identical to SEQ ID NO: 51829
  Payload ID: 10319
  Gene Symbol: MFF
  Gene Name: mitochondrial fission factor
  Uniprot ID: Q9GZY8
  ENSP ID: ENSP00000386964

SEQ ID NO: 51833 - protein, 32 aa, Homo sapiens
  Payload ID: 10319
  Gene Symbol: MFF
  Gene Name: mitochondrial fission factor
  ENSP ID: ENSP00000390165
MAEISRIQYEMEYTEGISQRMRVPEKLKVAPP

SEQ ID NO: 51834 - protein, 71 aa, Homo sapiens
  Payload ID: 10319
  Gene Symbol: MFF
  Gene Name: mitochondrial fission factor
  ENSP ID: ENSP00000391829
MSKGTSSDTSLGRVSRAAFPSPTAAEMAEISRIQYEMEYTEGISQRMRVPEKLKVAPPNADLEQGFQEGVP

SEQ ID NO: 51835 - protein, 60 aa, Homo sapiens
  Payload ID: 10319
  Gene Symbol: MFF
  Gene Name: mitochondrial fission factor
  ENSP ID: ENSP00000407547
MAEISRIQYEMEYTEGISQRMRVPEKLKVAPPNADLEQGFQEGVPNASVIMQVPERIVVA

SEQ ID NO: 51836 - protein, 34 aa, Homo sapiens
  Payload ID: 10319
  Gene Symbol: MFF
  Gene Name: mitochondrial fission factor
  ENSP ID: ENSP00000411386
MSKGTSSDTSLGRVSRAAFPSPTAAEMAEISRIQ

SEQ ID NO: 51837 - protein, 154 aa, Homo sapiens
  Payload ID: 10319
  Gene Symbol: MFF
  Gene Name: mitochondrial fission factor
  ENSP ID: ENSP00000415313
IRAVGRLKRERSMSENAVRQNGQLVRNDSLVTPSPQQARVCPPHMLPEDGANLSSARGILSLIQSSTRRAYQQILDVLDENRRYGISNIDTTIEGTSDDLTVVDAASLRRQIIKLNRRLQLLEEENKERAKREMVMYSITVAFWLLNSWLWFRR

SEQ ID NO: 51838 - protein, 138 aa, Homo sapiens
  Payload ID: 10319
  Gene Symbol: MFF
  Gene Name: mitochondrial fission factor
  ENSP ID: ENSP00000415996
MAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQN

SEQ ID NO: 51839 - protein, 59 aa, Homo sapiens
  Payload ID: 10319
  Gene Symbol: MFF
  Gene Name: mitochondrial fission factor
  ENSP ID: ENSP00000431725
MSENAVRQNGQLVRNDSLWHRSDSAPRNKISRFQAPISAPEYTVTPSPQQARVCPPHML

SEQ ID NO: 51840 - protein, 69 aa, Homo sapiens
  Payload ID: 10319
  Gene Symbol: MFF
  Gene Name: mitochondrial fission factor
  ENSP ID: ENSP00000432447
MSENAVRQNGQLVRNDSLVTPSPQQARVCPPHMLPEDGANLSSARGILSLIQSSTRRAYQQILDVLDEN

SEQ ID NO: 51841 - protein, 71 aa, Homo sapiens
  Payload ID: 10319
  Gene Symbol: MFF
  Gene Name: mitochondrial fission factor
  ENSP ID: ENSP00000435354
MSENAVRQNGQLVRNDSLWHRSDSAPRNKISRFQAPISAPEYTYGISNIDTTIEGTSDDLTVVDAASLRRQ

SEQ ID NO: 51842 - protein, 89 aa, Homo sapiens
  Payload ID: 10319
  Gene Symbol: MFF
  Gene Name: mitochondrial fission factor
  ENSP ID: ENSP00000436289
MSENAVRQNGQLVRNDSLYGISNIDTTIEGTSDDLTVVDAASLRRQIIKLNRRLQLLEEENKERAKREMVMYSITVAFWLLNSWLWFRR

SEQ ID NO: 51843 - protein, 52 aa, Homo sapiens
  Payload ID: 10319
  Gene Symbol: MFF
  Gene Name: mitochondrial fission factor
  ENSP ID: ENSP00000436920
MAEISRIQYEMEYTEGISQRMRVPEKLKVAPPNADLEQGFQEGVPNASVIMQ

SEQ ID NO: 51844 - protein, 166 aa, Homo sapiens
  Payload ID: 10320
  Gene Symbol: MTFP1
  Gene Name: mitochondrial fission process 1
  Uniprot ID: Q9UDX5
  ENSP ID: ENSP00000266263
MSEPQPRGAERDLYRDTWVRYLGYANEVGEAFRSLVPAAVVWLSYGVASSYVLADAIDKGKKAGEVPSPEAGRSARVTVAVVDTFVWQALASVAIPGFTINRVCAASLYVLGTATRWPLAVRKWTTTALGLLTIPIIIHPIDRSVDFLLDSSLRKLYPTVGKPSSS

SEQ ID NO: 51845 - protein, 135 aa, Homo sapiens
  Payload ID: 10320
  Gene Symbol: MTFP1
  Gene Name: mitochondrial fission process 1
  Uniprot ID: Q9UDX5
  ENSP ID: ENSP00000347267
MSEPQPRGAERDLYRDTWVRYLGYANEVGEAFRSLVPAAVVWLSYGVASSYVLADAIDKGKKAGEVGGFPPGLQPAQALPNSGEAQLLLIILWYLACASASCFMSTSYSCQGMWTPGSLVSKDPGTWVGLSWTEA

SEQ ID NO: 51846 - protein, 143 aa, Homo sapiens
  Payload ID: 10320
  Gene Symbol: MTFP1
  Gene Name: mitochondrial fission process 1
  ENSP ID: ENSP00000383926
MSEPQPRGAERDLYRDTWVRYLGYANEVGEAFRSLVPAAVVWLSYGVASSYVLADAIDKGKKAGEALASVAIPGFTINRVCAASLYVLGTATRWPLAVRKWTTTALGLLTIPIIIHPIDRSVDFLLDSSLRKLYPTVGKPSSS

SEQ ID NO: 51847 - protein, 74 aa, Homo sapiens
  Payload ID: 10320
  Gene Symbol: MTFP1
  Gene Name: mitochondrial fission process 1
  ENSP ID: ENSP00000393954
MSEPQPRGAERDLYRDTWVRYLGYANEVGEAFRSLVPAAVVWLSYGVASSYVLADAIDKGKKAGEDFLPLPQLD

SEQ ID NO: 51848 - protein, 74 aa, Homo sapiens; identical to SEQ ID NO: 51847
  Payload ID: 10320
  Gene Symbol: MTFP1
  Gene Name: mitochondrial fission process 1
  ENSP ID: ENSP00000487369

SEQ ID NO: 51849 - protein, 333 aa, Homo sapiens
  Payload ID: 10321
  Gene Symbol: MTFR1
  Gene Name: mitochondrial fission regulator 1
  Uniprot ID: Q15390
  ENSP ID: ENSP00000262146
MLGWIKRLIRMVFQQVGVSMQSVLWSRKPYGSSRSIVRKIGTNLSLIQCPRVQFQINSHATEWSPSHPGEDAVASFADVGWVAKEEGECSARLRTEVRSRPPLQDDLLFFEKAPSRQISLPDLSQEEPQLKTPALANEEALQKICALENELAALRAQIAKIVTQQEQQNLTAGDLDSTTFGTIPPHPPPPPPPLPPPALGLHQSTSAVDLIKERREKRANAGKTLVKNNPKKPEMPNMLEILKEMNSVKLRSVKRSEQDVKPKPVDATDPAALIAEALKKKFAYRYRSDSQDEVEKGIPKSESEATSERVLFGPHMLKPTGKMKALIENVSDS

SEQ ID NO: 51850 - protein, 300 aa, Homo sapiens
  Payload ID: 10321
  Gene Symbol: MTFR1
  Gene Name: mitochondrial fission regulator 1
  Uniprot ID: Q15390
  ENSP ID: ENSP00000391502
MLGWIKRLIRMVFQQVGVSMQSINSHATEWSPSHPGEDAVASFADVGWVAKEEGECSARLRTEVRSRPPLQDDLLFFEKAPSRQISLPDLSQEEPQLKTPALANEEALQKICALENELAALRAQIAKIVTQQEQQNLTAGDLDSTTFGTIPPHPPPPPPPLPPPALGLHQSTSAVDLIKERREKRANAGKTLVKNNPKKPEMPNMLEILKEMNSVKLRSVKRSEQDVKPKPVDATDPAALIAEALKKKFAYRYRSDSQDEVEKGIPKSESEATSERVLFGPHMLKPTGKMKALIENVSDS

SEQ ID NO: 51851 - protein, 144 aa, Homo sapiens
  Payload ID: 10321
  Gene Symbol: MTFR1
  Gene Name: mitochondrial fission regulator 1
  ENSP ID: ENSP00000429253
PHPPPPPPPLPPPALGLHQSTSAVDLIKERREKRANAGKTLVKNNPKKPEMPNMLEILKEMNSVKLRSVKRSEQDVKPKPVDATDPAALIAEALKKKFAYRYRSDSQDEVEKGIPKSESEATSERVLSLPAGFIQPHVSKHCLG

SEQ ID NO: 51852 - protein, 56 aa, Homo sapiens
  Payload ID: 10321
  Gene Symbol: MTFR1
  Gene Name: mitochondrial fission regulator 1
  ENSP ID: ENSP00000429450
MLGWIKRLIRMVFQQVGVSMQSVLWSRKPYGSSRSIVRKIGTNLSLIQCPRVQFQL

SEQ ID NO: 51853 - protein, 291 aa, Homo sapiens
  Payload ID: 10321
  Gene Symbol: MTFR1
  Gene Name: mitochondrial fission regulator 1
  ENSP ID: ENSP00000430621
  MOD_RES (1)..(1): Any amino acid
XMVFQQVGVSMQSINSHATEWSPSHPGEDAVASFADVGWVAKEEGECSARLRTEVRSRPPLQDDLLFFEKAPSRQISLPDLSQEEPQLKTPALANEEALQKICALENELAALRAQIAKIVTQQEQQNLTAGDLDSTTFGTIPPHPPPPPPPLPPPALGLHQSTSAVDLIKERREKRANAGKTLVKNNPKKPEMPNMLEILKEMNSVKLRSVKRSEQDVKPKPVDATDPAALIAEALKKKFAYRYRSDSQDEVEKGIPKSESEATSERVLFGPHMLKPTGKMKALIENVSDS

SEQ ID NO: 51854 - protein, 185 aa, Homo sapiens
  Payload ID: 10321
  Gene Symbol: MTFR1
  Gene Name: mitochondrial fission regulator 1
  ENSP ID: ENSP00000436928
  MOD_RES (1)..(1): Any amino acid
XPPPPPPLPPPALGLHQSTSAVDLIKERREKRANAGKTLVKNNPKKPEMPNMLEILKEMNSVKLRSVKRSEQDVKPKPVDATDPAALIAEALKKKFAYRYRSDSQDEVEKGIPKSESEATSERVLKRLVKVRTCWTRRPMANPTEDKFISLKRIRTMTKTIQTTIIHGRKYCGIYIIKWLRSFFC

SEQ ID NO: 51855 - protein, 292 aa, Homo sapiens
  Payload ID: 10322
  Gene Symbol: MTFR1L
  Gene Name: mitochondrial fission regulator 1-like
  Uniprot ID: Q9H019
  ENSP ID: ENSP00000363418
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAASASLTPDFLSPGSSNVSSPLPCFGSSFHSTTSFVISDITEETEVEVPELPSVPLLCSASPECCKPEHKAACSSSEEDDCVSLSKASSFADMMGILKDFHRMKQSQDLNRSLLKEEDPAVLISEVLRRKFALKEEDISRKGN

SEQ ID NO: 51856 - protein, 292 aa, Homo sapiens; identical to SEQ ID NO: 51855
  Payload ID: 10322
  Gene Symbol: MTFR1L
  Gene Name: mitochondrial fission regulator 1-like
  Uniprot ID: Q9H019
  ENSP ID: ENSP00000363419

SEQ ID NO: 51857 - protein, 292 aa, Homo sapiens; identical to SEQ ID NO: 51855
  Payload ID: 10322
  Gene Symbol: MTFR1L
  Gene Name: mitochondrial fission regulator 1-like
  Uniprot ID: Q9H019
  ENSP ID: ENSP00000363421

SEQ ID NO: 51858 - protein, 280 aa, Homo sapiens
  Payload ID: 10322
  Gene Symbol: MTFR1L
  Gene Name: mitochondrial fission regulator 1-like
  Uniprot ID: Q9H019
  ENSP ID: ENSP00000363426
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAGSSNVSSPLPCFGSSFHSTTSFVISDITEETEVEVPELPSVPLLCSASPECCKPEHKAACSSSEEDDCVSLSKASSFADMMGILKDFHRMKQSQDLNRSLLKEEDPAVLISEVLRRKFALKEEDISRKGN

SEQ ID NO: 51859 - protein, 152 aa, Homo sapiens
  Payload ID: 10322
  Gene Symbol: MTFR1L
  Gene Name: mitochondrial fission regulator 1-like
  ENSP ID: ENSP00000390841
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAAS

SEQ ID NO: 51860 - protein, 170 aa, Homo sapiens
  Payload ID: 10322
  Gene Symbol: MTFR1L
  Gene Name: mitochondrial fission regulator 1-like
  ENSP ID: ENSP00000431278
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAASASLTPDFLSPGSSNVSSP

SEQ ID NO: 51861 - protein, 52 aa, Homo sapiens
  Payload ID: 10322
  Gene Symbol: MTFR1L
  Gene Name: mitochondrial fission regulator 1-like
  ENSP ID: ENSP00000432014
MSGMEATVRPGIGARPPFHSLPLRRTNYDPGALQESVPSQSGKTSHMGLLEV

SEQ ID NO: 51862 - protein, 182 aa, Homo sapiens
  Payload ID: 10322
  Gene Symbol: MTFR1L
  Gene Name: mitochondrial fission regulator 1-like
  ENSP ID: ENSP00000432227
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAALNVANQNTKLPAVRLKRMTASLCPRPAALQT

SEQ ID NO: 51863 - protein, 160 aa, Homo sapiens
  Payload ID: 10322
  Gene Symbol: MTFR1L
  Gene Name: mitochondrial fission regulator 1-like
  ENSP ID: ENSP00000432719
MQRNASVPNLRGSEERLLALKKPALPALSRTTELQDELSHLRSQIAKIVAADAASASLTPDFLSPGSSNVSSPLPCFGSSFHSTTSFVISDITEETEVEVPELPSVPLLCSASPECCKPEHKAACSSSEEDDCVSLSKASSFADMMGILKDFHRMKQSQD

SEQ ID NO: 51864 - protein, 115 aa, Homo sapiens
  Payload ID: 10322
  Gene Symbol: MTFR1L
  Gene Name: mitochondrial fission regulator 1-like
  ENSP ID: ENSP00000434038
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLL

SEQ ID NO: 51865 - protein, 110 aa, Homo sapiens
  Payload ID: 10322
  Gene Symbol: MTFR1L
  Gene Name: mitochondrial fission regulator 1-like
  ENSP ID: ENSP00000434120
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGS

SEQ ID NO: 51866 - protein, 52 aa, Homo sapiens; identical to SEQ ID NO: 51861
  Payload ID: 10322
  Gene Symbol: MTFR1L
  Gene Name: mitochondrial fission regulator 1-like
  ENSP ID: ENSP00000434157

SEQ ID NO: 51867 - protein, 205 aa, Homo sapiens
  Payload ID: 10322
  Gene Symbol: MTFR1L
  Gene Name: mitochondrial fission regulator 1-like
  Uniprot ID: Q9H019
  ENSP ID: ENSP00000434751
MSGMEATVTIPIWQNKPHGAARSVVRRIGTNLPLKPCARASFETLPNISDLCLRDVPPVPTLADIAWIAADEEETYARVRSDTRPLRHTWKPSPLIVMQRNASVPNLRGSEERLLALKKPALPALSRTTELQDELSHLRSQIAKIVAADAVTSPRRQRWRSLSFHQSPCFVLPALNVANQNTKLPAVRLKRMTASLCPRPAALQT

SEQ ID NO: 51868 - protein, 13 aa, Homo sapiens
  Payload ID: 10322
  Gene Symbol: MTFR1L
  Gene Name: mitochondrial fission regulator 1-like
  ENSP ID: ENSP00000434773
MQRNASVPNLRGS

SEQ ID NO: 51869 - protein, 195 aa, Homo sapiens
  Payload ID: 10322
  Gene Symbol: MTFR1L
  Gene Name: mitochondrial fission regulator 1-like
  ENSP ID: ENSP00000435193
MQRNASVPNLRGSEERLLALKKPALPALSRTTELQDELSHLRSQIAKIVAADAASASLTPDFLSPGSSNVSSPLPCFGSSFHSTTSFVISDITEETEVEVPELPSVPLLCSASPECCKPEHKAACSSSEEDDCVSLSKASSFADMMGILKDFHRMKQSQDLNRSLLKEEDPAVLISEVLRRKFALKEEDISRKGN

SEQ ID NO: 51870 - protein, 205 aa, Homo sapiens; identical to SEQ ID NO: 51867
  Payload ID: 10322
  Gene Symbol: MTFR1L
  Gene Name: mitochondrial fission regulator 1-like
  Uniprot ID: Q9H019
  ENSP ID: ENSP00000435461

SEQ ID NO: 51871 - protein, 73 aa, Homo sapiens
  Payload ID: 10322
  Gene Symbol: MTFR1L
  Gene Name: mitochondrial fission regulator 1-like
  ENSP ID: ENSP00000435553
MSGMEATVRTGRKAWIISTLSYFLSPSLTLPTLTALAAADHPNLAKQATWGCSKCSKKNWDQPTLEAVCPGVL

SEQ ID NO: 51872 - protein, 52 aa, Homo sapiens; identical to SEQ ID NO: 51861
  Payload ID: 10322
  Gene Symbol: MTFR1L
  Gene Name: mitochondrial fission regulator 1-like
  ENSP ID: ENSP00000435745

SEQ ID NO: 51873 - protein, 53 aa, Homo sapiens
  Payload ID: 10322
  Gene Symbol: MTFR1L
  Gene Name: mitochondrial fission regulator 1-like
  ENSP ID: ENSP00000436954
MQRNASVPNLRGSEERLLALKKPALPALSRTTELQDELSHLRSQIAKIVAADA

SEQ ID NO: 51874 - protein, 44 aa, Homo sapiens
  Payload ID: 10323
  Gene Symbol: MTFR2
  Gene Name: mitochondrial fission regulator 2
  Uniprot ID: Q6P444
  ENSP ID: ENSP00000356758
MSLILNILREMLEYFGVPVEQLEVTSAYLSSLWKKQTGRNLRST

SEQ ID NO: 51875 - protein, 385 aa, Homo sapiens
  Payload ID: 10323
  Gene Symbol: MTFR2
  Gene Name: mitochondrial fission regulator 2
  Uniprot ID: Q6P444
  ENSP ID: ENSP00000395232
MSLILNILREMLEYFGVPVEQVLLIWENKDYGSTRSIVRIIGKMLPLEPCRRPNFELIPLLNSVDSDNCGSMVPSFADILYVANDEEASYLRFRNSIWKNEEEKVEIFHPLRLVRDPLSPAVRQKETVKNDLPVNEAAIRKIAALENELTFLRSQIAAIVEMQELKNSTNSSSFGLSDERISLGQLSSSRAAHLSVDPDQLPGSVLSPPPPPPLPPQFSSLQPPCFPPVQPGSNNICDSDNPATEMSKQNPAANKTNYSHHSKSQRNKDIPNMLDVLKDMNKVKLRAIERSPGGRPIHKRKRQNSHWDPVSLISHALKQKFAFQEDDSFEKENRSWESSPFSSPETSRFGHHISQSEGQRTKEEMVNTKAVDQGISNTSLLNSRI

SEQ ID NO: 51876 - protein, 385 aa, Homo sapiens; identical to SEQ ID NO: 51875
  Payload ID: 10323
  Gene Symbol: MTFR2
  Gene Name: mitochondrial fission regulator 2
  Uniprot ID: Q6P444
  ENSP ID: ENSP00000407010

SEQ ID NO: 51877 - protein, 245 aa, Homo sapiens
  Payload ID: 10323
  Gene Symbol: MTFR2
  Gene Name: mitochondrial fission regulator 2
  ENSP ID: ENSP00000410861
MLPLEPCRRPNFELIPLLNSVDSDNCGSMVPSFADILYVANDEEASYLRFRNSIWKNEEEKVEIFHPLRLVRDPLSPAVRQKETVKNDLPVNEAAIRKIAALENELTFLRSQIAAIVEMQELKNSTNSSSFGLSDERISLGQLSSSRAAHLSVDPDQLPGSVLSPPPPPPLPPQFSSLQPPCFPPVQPGSNNICDSDNPATEMSKQNPAANKTNYSHHSKSQRNKDIPNMLDVLKDMNKVKLRAI

SEQ ID NO: 51878 - protein, 115 aa, Homo sapiens
  Payload ID: 10323
  Gene Symbol: MTFR2
  Gene Name: mitochondrial fission regulator 2
  ENSP ID: ENSP00000435348
  MOD_RES (1)..(1): Any amino acid
XSQRNKDIPNMLDVLKDMNKVKLRAIERSPGGRPIHKRKRQNSHWDPVSLISHALKQKFAFQEDDSFEKENRSWESSPFSSPETSRVSYTNVKLIFQFFSDVLFMLQLCVQVLLK

SEQ ID NO: 51879 - protein, 252 aa, Homo sapiens
  Payload ID: 10324
  Gene Symbol: MGME1
  Gene Name: mitochondrial genome maintenance exonuclease 1
  ENSP ID: ENSP00000366933
MKMKLFQTICRQLRSSKFSVESAALVAFSTSSYSCGRKKKVNPYEEVDQEKYSNLVQSVLSSRGVAQTPGSVEEDALLCGPVSKHKLPNQGEDRRVPQNWFPIFNPERSDKPNASDPSVPLKIPLQRNVIPSVTRVLQQTMTKQQVFLLERWKQRMILELGEDGFKEYTSSSMWLNCGGLQRWITCPPTFHGCRALFPVLDQVASSTRRIYGKEKEPEYSETRIFRIGSKLLFGNIQHLLTVWEHILLFTPV

SEQ ID NO: 51880 - protein, 264 aa, Homo sapiens
  Payload ID: 10324
  Gene Symbol: MGME1
  Gene Name: mitochondrial genome maintenance exonuclease 1
  ENSP ID: ENSP00000366938
MKMKLFQTICRQLRSSKFSVESAALVAFSTSSYSCGRKKKVNPYEEVDQEKYSNLVQSVLSSRGVAQTPGSVEEDALLCGPVSKHKLPNQDVFLQGKRFHEALESILSPQETLKERDENLLKSGYIESVQHILKDVSGVRALESAVQHETLNYIGLLDCVAEYQGKLCVIDWKTSEKPKPFIQSTFDNPLQVVAYMGAMNHDTNYSFQVQCGLIVVAYKDGSPAHPHFMDAELCSQYWTKWLLRLEEYTEKKKNQNIQKPEYSE

SEQ ID NO: 51881 - protein, 344 aa, Homo sapiens
  Payload ID: 10324
  Gene Symbol: MGME1
  Gene Name: mitochondrial genome maintenance exonuclease 1
  Uniprot ID: Q9BQP7
  ENSP ID: ENSP00000366939
MKMKLFQTICRQLRSSKFSVESAALVAFSTSSYSCGRKKKVNPYEEVDQEKYSNLVQSVLSSRGVAQTPGSVEEDALLCGPVSKHKLPNQGEDRRVPQNWFPIFNPERSDKPNASDPSVPLKIPLQRNVIPSVTRVLQQTMTKQQVFLLERWKQRMILELGEDGFKEYTSNVFLQGKRFHEALESILSPQETLKERDENLLKSGYIESVQHILKDVSGVRALESAVQHETLNYIGLLDCVAEYQGKLCVIDWKTSEKPKPFIQSTFDNPLQVVAYMGAMNHDTNYSFQVQCGLIVVAYKDGSPAHPHFMDAELCSQYWTKWLLRLEEYTEKKKNQNIQKPEYSE

SEQ ID NO: 51882 - protein, 71 aa, Homo sapiens
  Payload ID: 10325
  Gene Symbol:
  Gene Name: Mitochondrial import inner membrane translocase subunit Tim10 B  [Source:UniProtKB/Swiss-Prot
  Acc:Q9Y5J6]
  ENSP ID: ENSP00000419490
MERQQQQQQQLRNEACLHSCAGKLIHSNHRLMAAYVQLMPALVQRRIADYEAASAVPGVAAEQPGVSPSGS

SEQ ID NO: 51883 - protein, 103 aa, Homo sapiens
  Payload ID: 10325
  Gene Symbol:
  Gene Name: Mitochondrial import inner membrane translocase subunit Tim10 B  [Source:UniProtKB/Swiss-Prot
  Acc:Q9Y5J6]
  Uniprot ID: Q9Y5J6
  ENSP ID: ENSP00000419704
MERQQQQQQQLRNLRDFLLVYNRMTELCFQRCVPSLHHRALDAEEEACLHSCAGKLIHSNHRLMAAYVQLMPALVQRRIADYEAASAVPGVAAEQPGVSPSGS

SEQ ID NO: 51884 - protein, 78 aa, Homo sapiens
  Payload ID: 10326
  Gene Symbol: MINOS1
  Gene Name: mitochondrial inner membrane organizing system 1
  Uniprot ID: Q5TGZ0
  ENSP ID: ENSP00000325562
MSESELGRKWDRCLADAVVKIGTGFGLGIVFSLTFFKRRMWPLAFGSGMGLGMAYSNCQHDFQAPYLLHGKYVKEQEQ

SEQ ID NO: 51885 - protein, 62 aa, Homo sapiens
  Payload ID: 10326
  Gene Symbol: MINOS1
  Gene Name: mitochondrial inner membrane organizing system 1
  ENSP ID: ENSP00000478278
MSESELGRKWDRCLADAVVKIGRMWPLAFGSGMGLGMAYSNCQHDFQAPYLLHGKYVKEQEQ

SEQ ID NO: 51886 - protein, 713 aa, Homo sapiens
  Payload ID: 10327
  Gene Symbol: MIPEP
  Gene Name: mitochondrial intermediate peptidase
  Uniprot ID: Q99797
  ENSP ID: ENSP00000371607
MLCVGRLGGLGARAAALPPRRAGRGSLEAGIRARRVSTSWSPVGAAFNVKPQGSRLDLFGERRGLFGVPELSAPEGFHIAQEKALRKTELLVDRACSTPPGPQTVLIFDELSDSLCRVADLADFVKIAHPEPAFREAAEEACRSIGTMVEKLNTNVDLYQSLQKLLADKKLVDSLDPETRRVAELFMFDFEISGIHLDKEKRKRAVDLNVKILDLSSTFLMGTNFPNKIEKHLLPEHIRRNFTSAGDHIIIDGLHAESPDDLVREAAYKIFLYPNAGQLKCLEELLSSRDLLAKLVGYSTFSHRALQGTIAKNPETVMQFLEKLSDKLSERTLKDFEMIRGMKMKLNPQNSEVMPWDPPYYSGVIRAERYNIEPSLYCPFFSLGACMEGLNILLNRLLGISLYAEQPAKGEVWSEDVRKLAVVHESEGLLGYIYCDFFQRADKPHQDCHFTIRGGRLKEDGDYQLPVVVLMLNLPRSSRSSPTLLTPSMMENLFHEMGHAMHSMLGRTRYQHVTGTRCPTDFAEVPSILMEYFANDYRVVNQFARHYQTGQPLPKNMVSRLCESKKVCAAADMQLQVFYATLDQIYHGKHPLRNSTTDILKETQEKFYGLPYVPNTAWQLRFSHLVGYGARYYSYLMSRAVASMVWKECFLQDPFNRAAGERYRREMLAHGGGREPMLMVEGMLQKCPSVDDFVSALVSDLDLDFETFLMDSE

SEQ ID NO: 51887 - protein, 389 aa, Homo sapiens
  Payload ID: 10328
  Gene Symbol: MTFMT
  Gene Name: mitochondrial methionyl-tRNA formyltransferase
  Uniprot ID: Q96DP5
  ENSP ID: ENSP00000220058
MRVLVRRCWGPPLAHGARRGRPSPQWRALARLGWEDCRDSRVREKPPWRVLFFGTDQFAREALRALHAARENKEEELIDKLEVVTMPSPSPKGLPVKQYAVQSQLPVYEWPDVGSGEYDVGVVASFGRLLNEALILKFPYGILNVHPSCLPRWRGPAPVIHTVLHGDTVTGVTIMQIRPKRFDVGPILKQETVPVPPKSTAKELEAVLSRLGANMLISVLKNLPESLSNGRQQPMEGATYAPKISAGTSCIKWEEQTSEQIFRLYRAIGNIIPLQTLWMANTIKLLDLVEVNSSVLADPKLTGQALIPGSVIYHKQSQILLVYCKDGWIGVRSVMLKKSLTATDFYNGYLHPWYQKNSQAQPSQCRFQTLRLPTKKKQKKTVAMQQCIE

SEQ ID NO: 51888 - protein, 144 aa, Homo sapiens
  Payload ID: 10328
  Gene Symbol: MTFMT
  Gene Name: mitochondrial methionyl-tRNA formyltransferase
  Uniprot ID: Q96DP5
  ENSP ID: ENSP00000443754
MRVLVRRCWGPPLAHGARRGRPSPQWRALARLGWEDCRDSRVREKPPWRVLFFGTDQFAREALRALHAARENKEEELIDKLEVVTMPSPSPKGLPVKQYAVQSQLPVYEWPDVGSGEYDVGVVASFGRLLNEALILKFPYSFQF

SEQ ID NO: 51889 - protein, 389 aa, Homo sapiens; identical to SEQ ID NO: 51887
  Payload ID: 10328
  Gene Symbol: MTFMT
  Gene Name: mitochondrial methionyl-tRNA formyltransferase
  Uniprot ID: Q96DP5
  ENSP ID: ENSP00000452646

SEQ ID NO: 51890 - protein, 134 aa, Homo sapiens
  Payload ID: 10328
  Gene Symbol: MTFMT
  Gene Name: mitochondrial methionyl-tRNA formyltransferase
  ENSP ID: ENSP00000457257
RRCWGPPLAHGARRGRPSPQWRALARLGWEDCRDSRVREKPPWRVLFFGTDQFAREALRALHAARENKEEELIDKLEVVTMPSPSPKGLPVKQYAVQSQLPVYEWPDVGSGEYDVGVVASFGRLLNEALILKFP

SEQ ID NO: 51891 - protein, 582 aa, Homo sapiens
  Payload ID: 10329
  Gene Symbol: MTPAP
  Gene Name: mitochondrial poly(A) polymerase
  Uniprot ID: Q9NVV4
  ENSP ID: ENSP00000263063
MAVPGVGLLTRLNLCARRRTRVQRPIVRLLSCPGTVAKDLRRDEQPSGSVETGFEDKIPKRRFSEMQNERREQAQRTVLIHCPEKISENKFLKYLSQFGPINNHFFYESFGLYAVVEFCQKESIGSLQNGTHTPSTAMETAIPFRSRFFNLKLKNQTSERSRVRSSNQLPRSNKQLFELLCYAESIDDQLNTLLKEFQLTEENTKLRYLTCSLIEDMAAAYFPDCIVRPFGSSVNTFGKLGCDLDMFLDLDETRNLSAHKISGNFLMEFQVKNVPSERIATQKILSVLGECLDHFGPGCVGVQKILNARCPLVRFSHQASGFQCDLTTNNRIALTSSELLYIYGALDSRVRALVFSVRCWARAHSLTSSIPGAWITNFSLTMMVIFFLQRRSPPILPTLDSLKTLADAEDKCVIEGNNCTFVRDLSRIKPSQNTETLELLLKEFFEYFGNFAFDKNSINIRQGREQNKPDSSPLYIQNPFETSLNISKNVSQSQLQKFVDLARESAWILQQEDTDRPSISSNRPWGLVSLLLPSAPNRKSFTKKKSNKFAIETVKNLLESLKGNRTENFTKTSGKRTISTQT

SEQ ID NO: 51892 - protein, 150 aa, Homo sapiens
  Payload ID: 10329
  Gene Symbol: MTPAP
  Gene Name: mitochondrial poly(A) polymerase
  ENSP ID: ENSP00000394118
DLRRDEQPSGSVETGFEDKIPKRRFSEMQNERREQAQRTVLIHCPEKISENKFLKYLSQFGPINNHFFYESFGLYAVVEFCQKESIGSLQNGTHTPSTAMETAIPFRSRFFNLKLKNQTSERSRVRSSNQLPRSNKQLFELLCYAESVSF

SEQ ID NO: 51893 - protein, 219 aa, Homo sapiens
  Payload ID: 10329
  Gene Symbol: MTPAP
  Gene Name: mitochondrial poly(A) polymerase
  ENSP ID: ENSP00000404392
MQNERREQAQRTVLIHCPEKISENKFLKYLSQFGPINNHFFYESFGLYAVVEFCQKESIGSLQNGTHTPSTAMETAIPFRSRFFNLKLKNQTSERSRVRSSNQLPRSNKQLFELLCYAESIDDQLNTLLKEFQLTEENTKLRYLTCSLIEDMAAAYFPDCIVRPFGSSVNTFGKLGCDLDMFLDLDETRNLSAHKISGNFLMEFQVKNVPSERIATQKI

SEQ ID NO: 51894 - protein, 66 aa, Homo sapiens
  Payload ID: 10330
  Gene Symbol: MPC1
  Gene Name: mitochondrial pyruvate carrier 1
  ENSP ID: ENSP00000340784
MKKSPEIISGRMTFALCCYSLTFMRFAYKVQPRNWLLFACHATNEVAQLIQGGRLIKHEMTKTASA

SEQ ID NO: 51895 - protein, 109 aa, Homo sapiens
  Payload ID: 10330
  Gene Symbol: MPC1
  Gene Name: mitochondrial pyruvate carrier 1
  Uniprot ID: Q9Y5U8
  ENSP ID: ENSP00000354223
MAGALVRKAADYVRSKDFRDYLMSTHFWGPVANWGLPIAAINDMKKSPEIISGRMTFALCCYSLTFMRFAYKVQPRNWLLFACHATNEVAQLIQGGRLIKHEMTKTASA

SEQ ID NO: 51896 - protein, 66 aa, Homo sapiens; identical to SEQ ID NO: 51894
  Payload ID: 10330
  Gene Symbol: MPC1
  Gene Name: mitochondrial pyruvate carrier 1
  ENSP ID: ENSP00000477853

SEQ ID NO: 51897 - protein, 109 aa, Homo sapiens
  Payload ID: 10330
  Gene Symbol: MPC1
  Gene Name: mitochondrial pyruvate carrier 1
  ENSP ID: ENSP00000479789
MAGALVRKAADYVRSKDFRDYLMRTHFWGPVANWGLPIAAINDMKKSPEIISGRMTFALCCYSLTFMRFAYKVQPRNWLLFACHATNEVAQLIQGGRLIKHEMTKTASA

SEQ ID NO: 51898 - protein, 127 aa, Homo sapiens [sequence omitted]

SEQ ID NO: 51899 - protein, 127 aa, Homo sapiens [sequence omitted]

SEQ ID NO: 51900 - protein, 105 aa, Homo sapiens
  Payload ID: 10331
  Gene Symbol: MPC2
  Gene Name: mitochondrial pyruvate carrier 2
  ENSP ID: ENSP00000392874
MSAAGARGLRATYHRLLDKVELMLPEKLRPLYNHPAGPRTVFFWAPIMKWGLVCAGLADMARPAEKLSTAQSAVLMATGFIWSRYSLVIIPKNWSLFAVNFFVGA

SEQ ID NO: 51901 - protein, 325 aa, Homo sapiens
  Payload ID: 10332
  Gene Symbol: MRPL1
  Gene Name: mitochondrial ribosomal protein L1
  Uniprot ID: Q9BYD6
  ENSP ID: ENSP00000315017
MAAAVRCMGRALIHHQRHSLSKMVYQTSLCSCSVNIRVPNRHFAAATKSAKKTKKGAKEKTPDEKKDEIEKIKAYPYMEGEPEDDVYLKRLYPRQIYEVEKAVHLLKKFQILDFTSPKQSVYLDLTLDMALGKKKNVEPFTSVLSLPYPFASEINKVAVFTENASEVKIAEENGAAFAGGTSLIQKIWDDEIVADFYVAVPEIMPELNRLRKKLNKKYPKLSRNSIGRDIPKMLELFKNGHEIKVDEERENFLQTKIATLDMSSDQIAANLQAVINEVCRHRPLNLGPFVVRAFLRSSTSEGLLLKIDPLLPKEVKNEESEKEDA

SEQ ID NO: 51902 - protein, 231 aa, Homo sapiens
  Payload ID: 10332
  Gene Symbol: MRPL1
  Gene Name: mitochondrial ribosomal protein L1
  ENSP ID: ENSP00000421616
  MOD_RES (1)..(1): Any amino acid
XRSAKKTKKGAKEKTPDEKKDEIEKIKAYPYMEGEPEDDVYLKRLYPRQIYEVEKAVHLLKKFQILDFTSPKQSVYLDLTLDMALGKKKNVEPFTSVLSLPYPFASEINKVAVFTENASEVKIAEENGAAFAGGTSLIQKIWDDEIVADFYVAVPEIMPELNRLRKKLNKKYPKLSRNSIGRDIPKMLELFKNGHEIKVDEERENFLQTKIATVPLWYVLSFVVQQVKVYY

SEQ ID NO: 51903 - protein, 271 aa, Homo sapiens
  Payload ID: 10333
  Gene Symbol: MRPL10
  Gene Name: mitochondrial ribosomal protein L10
  Uniprot ID: Q7Z7H8
  ENSP ID: ENSP00000290208
MISAHCNLHLPGSSDSPASASQVAGITGRLPTLQTVRYGSKAVTRHRRVMHFQRQKLMAVTEYIPPKPAIHPSCLPSPPSPPQEEIGLIRLLRREIAAVFQDNRMIAVCQNVALSAEDKLLMRHQLRKHKILMKVFPNQVLKPFLEDSKYQNLLPLFVGHNMLLVSEEPKVKEMVRILRTVPFLPLLGGCIDDTILSRQGFINYSKLPSLPLVQGELVGGLTCLTAQTHSLLQHQPLQLTTLLDQYIREQREKDSVMSANGKPDPDTVPDS

SEQ ID NO: 51904 - protein, 261 aa, Homo sapiens [sequence omitted]

SEQ ID NO: 51905 - protein, 48 aa, Homo sapiens
  Payload ID: 10333
  Gene Symbol: MRPL10
  Gene Name: mitochondrial ribosomal protein L10
  ENSP ID: ENSP00000390624
MAAAVAGMLRGGLLPQAGKEWPRSSRRVLRPLSSPHLPSSTTDSSHNL

SEQ ID NO: 51906 - protein, 271 aa, Homo sapiens; identical to SEQ ID NO: 51903
  Payload ID: 10333
  Gene Symbol: MRPL10
  Gene Name: mitochondrial ribosomal protein L10
  Uniprot ID: Q7Z7H8
  ENSP ID: ENSP00000395870

SEQ ID NO: 51907 - protein, 48 aa, Homo sapiens; identical to SEQ ID NO: 51905
  Payload ID: 10333
  Gene Symbol: MRPL10
  Gene Name: mitochondrial ribosomal protein L10
  ENSP ID: ENSP00000404039

SEQ ID NO: 51908 - protein, 192 aa, Homo sapiens [sequence omitted]

SEQ ID NO: 51909 - protein, 181 aa, Homo sapiens
  Payload ID: 10334
  Gene Symbol: MRPL11
  Gene Name: mitochondrial ribosomal protein L11
  Uniprot ID: Q9Y3B7
  ENSP ID: ENSP00000329630
MSKLGRAARGLRKPEVGGVIRAIVRAGLAMPGPPLGPVLGQRGVSINQFCKEFNERTKDIKEGIPLPTKILVKPDRTFEIKIGQPTVSYFLKAAAGIEKGARQTGKEVAGLVTLKHVYEIARIKAQDEAFALQDVPLSSVVRSIIGSARSLGIRVVKERCSANVLRNGKISMKDPSGRSSV

SEQ ID NO: 51910 - protein, 166 aa, Homo sapiens
  Payload ID: 10334
  Gene Symbol: MRPL11
  Gene Name: mitochondrial ribosomal protein L11
  Uniprot ID: Q9Y3B7
  ENSP ID: ENSP00000415356
MSKLGRAARGLRKPERGVSINQFCKEFNERTKDIKEGIPLPTKILVKPDRTFEIKIGQPTVSYFLKAAAGIEKGARQTGKEVAGLVTLKHVYEIARIKAQDEAFALQDVPLSSVVRSIIGSARSLGIRVVKDLSSEELAAFQKERAIFLAAQKEADLAAQEEAAKK

SEQ ID NO: 51911 - protein, 63 aa, Homo sapiens
  Payload ID: 10334
  Gene Symbol: MRPL11
  Gene Name: mitochondrial ribosomal protein L11
  ENSP ID: ENSP00000431405
EIARIKAQDEAFALQDVPLSSVVRSIIGSARSLGIRVVKERCSANVLRNGKISMKDPSGRSSV

SEQ ID NO: 51912 - protein, 75 aa, Homo sapiens
  Payload ID: 10334
  Gene Symbol: MRPL11
  Gene Name: mitochondrial ribosomal protein L11
  ENSP ID: ENSP00000436904
MSKLGRAARGLRKPEVGGVIRAIVRAGLAMPGPPLGPVLGQRGVSINQFCKEFNERTKDIKEGIPLPTKILVKDI

SEQ ID NO: 51913 - protein, 198 aa, Homo sapiens [sequence omitted]

SEQ ID NO: 51914 - protein, 178 aa, Homo sapiens
  Payload ID: 10335
  Gene Symbol: MRPL12
  Gene Name: mitochondrial ribosomal protein L12
  ENSP ID: ENSP00000439565
MLPAAARPLWGPCLGLRAAAFRLARRQVPCVCAVRHMRSSGHQRCEALAGAPLDNAPKEYPPKIQQLVQDIASLTLLEISDLNELLKKTLKIQDVGLVPMGGVMSGAVPAAAAQEAVEEDIPIAKERTHFTVRLTEAKPVDKVKLIKEIKNYIKASTSSRQRSWWSPCPGNQSQCRQS

SEQ ID NO: 51915 - protein, 178 aa, Homo sapiens
  Payload ID: 10336
  Gene Symbol: MRPL13
  Gene Name: mitochondrial ribosomal protein L13
  Uniprot ID: Q9BYD1
  ENSP ID: ENSP00000306548
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDEYTQEEIDAFPRLWTPPEDYRL

SEQ ID NO: 51916 - protein, 47 aa, Homo sapiens
  Payload ID: 10336
  Gene Symbol: MRPL13
  Gene Name: mitochondrial ribosomal protein L13
  ENSP ID: ENSP00000428229
YIPEDILKNLVEELPQPRKIPKRLDEYTQEEIDAFPRLWTPPEDYRL

SEQ ID NO: 51917 - protein, 58 aa, Homo sapiens
  Payload ID: 10336
  Gene Symbol: MRPL13
  Gene Name: mitochondrial ribosomal protein L13
  ENSP ID: ENSP00000428867
MSSFSRAPQQWATFARIWYLLDGKMQPPGKLAAMASIRLQGLHKPVYHALTTQVDLDK

SEQ ID NO: 51918 - protein, 147 aa, Homo sapiens
  Payload ID: 10336
  Gene Symbol: MRPL13
  Gene Name: mitochondrial ribosomal protein L13
  ENSP ID: ENSP00000430545
MQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDEYTQEEIDAFPRLWT

SEQ ID NO: 51919 - protein, 145 aa, Homo sapiens [sequence omitted]

SEQ ID NO: 51920 - protein, 296 aa, Homo sapiens [sequence omitted]

SEQ ID NO: 51921 - protein, 198 aa, Homo sapiens
  Payload ID: 10338
  Gene Symbol: MRPL15
  Gene Name: mitochondrial ribosomal protein L15
  ENSP ID: ENSP00000428581
MAGPLQGGGARALDLLRGLPRVSLANLKPNPGSKKPERRPRGRRRGRKCGRGHKGERQRGTRPRLGFEGGQTPFYIRIPKYGFNEGHSFRRQYKPLSLNRLQYLIDLGRVDPSQPIDLTQLVNGRGVTIQPLKRDYGVQLVEEGADTFTAKVNIEVQLASELAIAAIEKNGGVVTTAFYDPRSLGKFVPRSFSSFSLC

SEQ ID NO: 51922 - protein, 237 aa, Homo sapiens
  Payload ID: 10338
  Gene Symbol: MRPL15
  Gene Name: mitochondrial ribosomal protein L15
  ENSP ID: ENSP00000429252
QERRPRGRRRGQTPFYIRIPKYGFNEGHSFRRQYKPLSLNRLQYLIDLGRVDPSQPIDLTQLVNGRGVTIQPLKRDYGVQLVEEGADTFTAKVNIEVQLASELAIAAIEKNGGVVTTAFYDPRSLDIVCKPVPFFLRGQPIPKRMLPPEELVPYYTDAKNRGYLADPAKFPEARLELARKYGYILPDITKDELFKMLCTRKDPRQIFFGLAPGWVVNMADKKILKPTDENLLKYYTS

SEQ ID NO: 51923 - protein, 251 aa, Homo sapiens [sequence omitted]

SEQ ID NO: 51924 - protein, 86 aa, Homo sapiens
  Payload ID: 10339
  Gene Symbol: MRPL16
  Gene Name: mitochondrial ribosomal protein L16
  ENSP ID: ENSP00000436592
MMRLTINRSMDPKNMFAIWRVPAPFKPITRKSVGHRMGGGKGAIDHYVTPVKAGRLVVEMGGRCEFEEVQGFLDQVAHKLPFAAKA

SEQ ID NO: 51925 - protein, 175 aa, Homo sapiens [sequence omitted]

SEQ ID NO: 51926 - protein, 142 aa, Homo sapiens
  Payload ID: 10340
  Gene Symbol: MRPL17
  Gene Name: mitochondrial ribosomal protein L17
  ENSP ID: ENSP00000435294
MRLSVAAAISHGRVFRRMGLGPESRIHLLRNLLTGLVRHERIEAPWARVDEMRGYAEKEKDLIPKLFQVLAPRYKDQTGGYTRMLQIPNRSLDRAKMAVIEYKGNCLPPLPLPRRDSHLTLLNQLLQGLRQDLRQSQEASNH

SEQ ID NO: 51927 - protein, 180 aa, Homo sapiens [sequence omitted]

SEQ ID NO: 51928 - protein, 173 aa, Homo sapiens
  Payload ID: 10342
  Gene Symbol: MRPL19
  Gene Name: mitochondrial ribosomal protein L19
  ENSP ID: ENSP00000351639
MAACIAAGHWAAMGLGRSFQAARTLLPPPASIACRVHAGPVRQQSTGPSEPGAFQPPPKPVIVDKHRPVEPERRFLSPEFIPRRGRTDPLKFQIERKDMLERRKVLHIPEFYVGSILRVTTADPYASGKISQFLGICIQRSGRGLGATFILRNVIEGQGPVYIHNPERWLPGP

SEQ ID NO: 51929 - protein, 292 aa, Homo sapiens [sequence omitted]

SEQ ID NO: 51930 - protein, 292 aa, Homo sapiens [sequence omitted]

SEQ ID NO: 51931 - protein, 79 aa, Homo sapiens
  Payload ID: 10342
  Gene Symbol: MRPL19
  Gene Name: mitochondrial ribosomal protein L19
  ENSP ID: ENSP00000406267
KVPVNELKVKMKPKPWSKRWERPNFNIKGIRFDLCLTEQQMKEAQKWNQPWLEFDMMREYDTSKIEAAIWKEIEASKRS

SEQ ID NO: 51932 - protein, 143 aa, Homo sapiens
  Payload ID: 10342
  Gene Symbol: MRPL19
  Gene Name: mitochondrial ribosomal protein L19
  ENSP ID: ENSP00000474821
MLERRKVLHIPEFYVGSILRVTTADPYASGKISQFLGICIQRSGRGLGATFILRNVIEGQGVEICFELYNPRVQEIQVVKLEKRLDDSLLYLRDALPEYSTFDVNMKPVVQEPNQKVPVNELKVKMKPKPWSKRWERPNFNIK

SEQ ID NO: 51933 - protein, 58 aa, Homo sapiens
  Payload ID: 10342
  Gene Symbol: MRPL19
  Gene Name: mitochondrial ribosomal protein L19
  ENSP ID: ENSP00000475090
  MOD_RES (1)..(1): Any amino acid
XVKLEKRLDDSLLYLRDALPEYSTFDVNMKPVVQEPNQKVPVNEPGAIKYKTTGPRDS

SEQ ID NO: 51934 - protein, 225 aa, Homo sapiens
  Payload ID: 10343
  Gene Symbol: MRPL2
  Gene Name: mitochondrial ribosomal protein L2
  ENSP ID: ENSP00000230413
MALCALTRALRSLNLAPPTVAAPAPSLFPAAQMMNNGLLQQPSALMLLPCRPVLTSVALNANFVSWKSRTKYTITPVKMRKSGGRDHTGRIRVHGIGGGHKQRYRMIDFLRFRPEETKSGPFEEKVIQVRYDPCRSADIALVAGGSRKRWIIATENMQAGDTILNSNHIGRMAVAAREGDAHPLGALPVGTLINNVESEPGRGAQYIRAAGAGNVRSNSRPSIQR

SEQ ID NO: 51935 - protein, 305 aa, Homo sapiens [sequence omitted]

SEQ ID NO: 51936 - protein, 94 aa, Homo sapiens
  Payload ID: 10343
  Gene Symbol: MRPL2
  Gene Name: mitochondrial ribosomal protein L2
  ENSP ID: ENSP00000417101
MALCALTRALRSLNLAPPTVAAPAPSLFPAAQVIHLTREEGCFHSGCRRWGLRACEAGVASLVRSHADDEQWPPPTALCLDVAPLPPSSYFCGP

SEQ ID NO: 51937 - protein, 96 aa, Homo sapiens
  Payload ID: 10343
  Gene Symbol: MRPL2
  Gene Name: mitochondrial ribosomal protein L2
  ENSP ID: ENSP00000419710
MALCALTRALRSLNLAPPTVAAPAPSLFPAAQMMNNGLLQQPSALMLLPCRPVLTSVALNANFVSWKSRTKYTITPVKMRKSGGRDHTGGNKDRGI

SEQ ID NO: 51938 - protein, 103 aa, Homo sapiens
  Payload ID: 10343
  Gene Symbol: MRPL2
  Gene Name: mitochondrial ribosomal protein L2
  ENSP ID: ENSP00000419753
MALCALTRALRSLNLAPPTVAAPAPSLFPAAQMMNNGLLQQPSALMLLPCRPVLTSVALNANFVSWKSRTKYTITPVKMRKSGGRDHTGAGNVRSNSRPSIQR

SEQ ID NO: 51939 - protein, 149 aa, Homo sapiens
  Payload ID: 10344
  Gene Symbol: MRPL20
  Gene Name: mitochondrial ribosomal protein L20
  Uniprot ID: Q9BYC9
  ENSP ID: ENSP00000341082
MVFLTAQLWLRNRVTDRYFRIQEVLKHARHFRGRKNRCYRLAVRTVIRAFVKCTKARYLKKKNMRTLWINRITAASQEHGLKYPALIGNLVKCQVELNRKVLADLAIYEPKTFKSLAALASRRRHEGFAAALGDGKEPEGIFSRVVQYH

SEQ ID NO: 51940 - protein, 66 aa, Homo sapiens
  Payload ID: 10344
  Gene Symbol: MRPL20
  Gene Name: mitochondrial ribosomal protein L20
  ENSP ID: ENSP00000459994
RCYRLAVRTVIRAFVKCTKARYLKKKNMRTLWINRITAASQEHGLKYPALIGNLVKALPGWLKGLP

SEQ ID NO: 51941 - protein, 155 aa, Homo sapiens
  Payload ID: 10344
  Gene Symbol: MRPL20
  Gene Name: mitochondrial ribosomal protein L20
  Uniprot ID: Q9BYC9
  ENSP ID: ENSP00000460924
MVFLTAQLWLRNRVTDRYFRIQEVLKHARHFRGRKNRCYRLAVRTVIRAFVKCTKARYLKKKNMRTLWINRITAASQEHGLKYPALIGNLVKVWVSMWVPLKFWTSAETIMRGVVVLPVVPANQEAEARGSLETDFWAVVCYADGVSMLSVVSIW

SEQ ID NO: 51942 - protein, 205 aa, Homo sapiens
  Payload ID: 10345
  Gene Symbol: MRPL21
  Gene Name: mitochondrial ribosomal protein L21
  Uniprot ID: Q7Z2W9
  ENSP ID: ENSP00000354580
MAASSLTVTLGRLASACSHSILRPSGPGAASLWSASRRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 51943 - protein, 120 aa, Homo sapiens
  Payload ID: 10345
  Gene Symbol: MRPL21
  Gene Name: mitochondrial ribosomal protein L21
  Uniprot ID: Q7Z2W9
  ENSP ID: ENSP00000389400
MIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 51944 - protein, 36 aa, Homo sapiens
  Payload ID: 10345
  Gene Symbol: MRPL21
  Gene Name: mitochondrial ribosomal protein L21
  ENSP ID: ENSP00000438837
MAASSLTVTLGRLASACSHSILRPSGPGADMFLKHP

SEQ ID NO: 51945 - protein, 150 aa, Homo sapiens
  Payload ID: 10345
  Gene Symbol: MRPL21
  Gene Name: mitochondrial ribosomal protein L21
  ENSP ID: ENSP00000442243
MAASSLTVTLGRLASACSHSILRPSGPGAASLWSASRRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLG

SEQ ID NO: 51946 - protein, 49 aa, Homo sapiens
  Payload ID: 10345
  Gene Symbol: MRPL21
  Gene Name: mitochondrial ribosomal protein L21
  ENSP ID: ENSP00000445009
MAASSLTVTLGRLASACSHSILRPSGPGAASLWSASRRFNSQSTSYLPG

SEQ ID NO: 51947 - protein, 49 aa, Homo sapiens; identical to SEQ ID NO: 51946
  Payload ID: 10345
  Gene Symbol: MRPL21
  Gene Name: mitochondrial ribosomal protein L21
  ENSP ID: ENSP00000456520

SEQ ID NO: 51948 - protein, 195 aa, Homo sapiens
  Payload ID: 10345
  Gene Symbol: MRPL21
  Gene Name: mitochondrial ribosomal protein L21
  ENSP ID: ENSP00000457859
MIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRSKLEKVPLGPVARCWLPRRMRTEGVGHVGLGTGSPGRSQPGCHCPLATLILEGAPRGSSLAPLLLHAPRVTPPRSPSPPRSARDPTSLPFSSTLRA

SEQ ID NO: 51949 - protein, 126 aa, Homo sapiens
  Payload ID: 10346
  Gene Symbol: MRPL22
  Gene Name: mitochondrial ribosomal protein L22
  Uniprot ID: Q9NWU5
  ENSP ID: ENSP00000265229
MWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 51950 - protein, 232 aa, Homo sapiens
  Payload ID: 10346
  Gene Symbol: MRPL22
  Gene Name: mitochondrial ribosomal protein L22
  ENSP ID: ENSP00000411177
MAAAVLGQLGKDFLVVKRQKGVEMESELTACVDVAGALWIHNLRSRGKLALGVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 51951 - protein, 212 aa, Homo sapiens
  Payload ID: 10346
  Gene Symbol: MRPL22
  Gene Name: mitochondrial ribosomal protein L22
  ENSP ID: ENSP00000429039
MAAAVLGQLGALWIHNLRSRGKLALGLLSFHSVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 51952 - protein, 38 aa, Homo sapiens
  Payload ID: 10346
  Gene Symbol: MRPL22
  Gene Name: mitochondrial ribosomal protein L22
  ENSP ID: ENSP00000430648
EMESELTACVDVAGALWIHNLRSRGKLALGKSTTVEDK

SEQ ID NO: 51953 - protein, 206 aa, Homo sapiens
  Payload ID: 10346
  Gene Symbol: MRPL22
  Gene Name: mitochondrial ribosomal protein L22
  Uniprot ID: Q9NWU5
  ENSP ID: ENSP00000431040
MAAAVLGQLGALWIHNLRSRGKLALGVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 51954 - protein, 228 aa, Homo sapiens
  Payload ID: 10346
  Gene Symbol: MRPL22
  Gene Name: mitochondrial ribosomal protein L22
  ENSP ID: ENSP00000481879
MAAAVLGQLGALWIHNLRSRGKLALGVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQFAAGPSFTLYDEEIQTPQCIYFAIYFLKINKN

SEQ ID NO: 51955 - protein, 163 aa, Homo sapiens
  Payload ID: 10347
  Gene Symbol: MRPL23
  Gene Name: mitochondrial ribosomal protein L23
  ENSP ID: ENSP00000370925
MARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLVPHPRSLPLCLQHRSQLRTPRIPCIVAFASWGPGSKHDACSALCVVARAWAAVYVSARLISVAG

SEQ ID NO: 51956 - protein, 153 aa, Homo sapiens
  Payload ID: 10347
  Gene Symbol: MRPL23
  Gene Name: mitochondrial ribosomal protein L23
  Uniprot ID: Q16540
  ENSP ID: ENSP00000370930
MARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLAHGQTFTFPDLFPEKDESPEGSAADDLYSMLEEERQQRQSSDPRRGGVPSWFGL

SEQ ID NO: 51957 - protein, 166 aa, Homo sapiens
  Payload ID: 10347
  Gene Symbol: MRPL23
  Gene Name: mitochondrial ribosomal protein L23
  ENSP ID: ENSP00000380462
MARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLPSQTPSKEQNGQGSTLCFRSSCSKGWSTWGTRDPRPAWSPVGGRIPRKAGSGGPANRIAQDGRLLLK

SEQ ID NO: 51958 - protein, 191 aa, Homo sapiens
  Payload ID: 10347
  Gene Symbol: MRPL23
  Gene Name: mitochondrial ribosomal protein L23
  ENSP ID: ENSP00000380465
MARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLPSQTPSKEQNGQGSTLCFRSSCSKGWSTWGTRDPRPAWSPVGGRIPRKAGSGGPANRIAQDGRLLLKNLRPRVPRREQPATRFPLWRRGVLA

SEQ ID NO: 51959 - protein, 153 aa, Homo sapiens; identical to SEQ ID NO: 51956
  Payload ID: 10347
  Gene Symbol: MRPL23
  Gene Name: mitochondrial ribosomal protein L23
  Uniprot ID: Q16540
  ENSP ID: ENSP00000380466

SEQ ID NO: 51960 - protein, 118 aa, Homo sapiens
  Payload ID: 10347
  Gene Symbol: MRPL23
  Gene Name: mitochondrial ribosomal protein L23
  ENSP ID: ENSP00000407156
  MOD_RES (1)..(1): Any amino acid
XYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLVPKEQYPLLLVNPSHMLWPGLGLG

SEQ ID NO: 51961 - protein, 216 aa, Homo sapiens
  Payload ID: 10348
  Gene Symbol: MRPL24
  Gene Name: mitochondrial ribosomal protein L24
  Uniprot ID: Q96A35
  ENSP ID: ENSP00000354525
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERVRVSTRSGRIIPKPEFPRADGIVPETWIDGPKDTSVEDALERTYVPCLKTLQEEVMEAMGIKETRKYKKVYWY

SEQ ID NO: 51962 - protein, 216 aa, Homo sapiens; identical to SEQ ID NO: 51961
  Payload ID: 10348
  Gene Symbol: MRPL24
  Gene Name: mitochondrial ribosomal protein L24
  Uniprot ID: Q96A35
  ENSP ID: ENSP00000357194

SEQ ID NO: 51963 - protein, 98 aa, Homo sapiens
  Payload ID: 10348
  Gene Symbol: MRPL24
  Gene Name: mitochondrial ribosomal protein L24
  ENSP ID: ENSP00000406681
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYI

SEQ ID NO: 51964 - protein, 68 aa, Homo sapiens
  Payload ID: 10348
  Gene Symbol: MRPL24
  Gene Name: mitochondrial ribosomal protein L24
  ENSP ID: ENSP00000409803
MRLSALLALASKVTLPPHYRYGMSPPGSVADKRKNPPWIRRRPVVVEPISDEDWYLFCGDTVEILEGK

SEQ ID NO: 51965 - protein, 173 aa, Homo sapiens
  Payload ID: 10348
  Gene Symbol: MRPL24
  Gene Name: mitochondrial ribosomal protein L24
  ENSP ID: ENSP00000411369
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERVRVSTRSGRIIPKPEFPRADGIVPETWIDG

SEQ ID NO: 51966 - protein, 148 aa, Homo sapiens
  Payload ID: 10349
  Gene Symbol: MRPL27
  Gene Name: mitochondrial ribosomal protein L27
  Uniprot ID: Q9P0M9
  ENSP ID: ENSP00000225969
MASVVLALRTRTAVTSLLSPTPATALAVRYASKKSGGSSKNLGGKSSGRRQGIKKMEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 51967 - protein, 94 aa, Homo sapiens
  Payload ID: 10349
  Gene Symbol: MRPL27
  Gene Name: mitochondrial ribosomal protein L27
  ENSP ID: ENSP00000388915
MASVVLALRTRTAVTSLLSPTPATALAVRYASKKSGGSSKNLGGKSSGRRQGIKKMEGHYVHAGNIIATQRHFRWHPGAHVSCSVAAPLFPFLG

SEQ ID NO: 51968 - protein, 93 aa, Homo sapiens
  Payload ID: 10349
  Gene Symbol: MRPL27
  Gene Name: mitochondrial ribosomal protein L27
  ENSP ID: ENSP00000421865
MEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 51969 - protein, 136 aa, Homo sapiens
  Payload ID: 10349
  Gene Symbol: MRPL27
  Gene Name: mitochondrial ribosomal protein L27
  ENSP ID: ENSP00000424321
  MOD_RES (1)..(1): Any amino acid
XSPTPATALAVRYASKKSGGSSKNLGGKSSGRRQGIKKMEGHYVHAGNIIATQRHFRWHPGAHVCVLQVGVGKNKCLYALEEGIVRYTKEVYVPHPRNTEAVDLITRLPKGAVLYKTFVHVVPAKPEGTFKLVAML

SEQ ID NO: 51970 - protein, 84 aa, Homo sapiens
  Payload ID: 10349
  Gene Symbol: MRPL27
  Gene Name: mitochondrial ribosomal protein L27
  ENSP ID: ENSP00000425126
MASVVLALRTRTAVTSLLSPTPATALAVRYASKKSGGSSKNLGGKSSGRRQGIKKMEGHYVHAGNIIATQRHFRWHPGAHWRWK

SEQ ID NO: 51971 - protein, 93 aa, Homo sapiens; identical to SEQ ID NO: 51968
  Payload ID: 10349
  Gene Symbol: MRPL27
  Gene Name: mitochondrial ribosomal protein L27
  ENSP ID: ENSP00000426037

SEQ ID NO: 51972 - protein, 256 aa, Homo sapiens
  Payload ID: 10350
  Gene Symbol: MRPL28
  Gene Name: mitochondrial ribosomal protein L28
  Uniprot ID: Q13084
  ENSP ID: ENSP00000199706
MPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQQALSEPAVVQKRASGQ

SEQ ID NO: 51973 - protein, 256 aa, Homo sapiens; identical to SEQ ID NO: 51972
  Payload ID: 10350
  Gene Symbol: MRPL28
  Gene Name: mitochondrial ribosomal protein L28
  Uniprot ID: Q13084
  ENSP ID: ENSP00000374326

SEQ ID NO: 51974 - protein, 218 aa, Homo sapiens
  Payload ID: 10350
  Gene Symbol: MRPL28
  Gene Name: mitochondrial ribosomal protein L28
  ENSP ID: ENSP00000390399
MPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLL

SEQ ID NO: 51975 - protein, 194 aa, Homo sapiens
  Payload ID: 10350
  Gene Symbol: MRPL28
  Gene Name: mitochondrial ribosomal protein L28
  ENSP ID: ENSP00000395305
MPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEF

SEQ ID NO: 51976 - protein, 240 aa, Homo sapiens
  Payload ID: 10350
  Gene Symbol: MRPL28
  Gene Name: mitochondrial ribosomal protein L28
  ENSP ID: ENSP00000398684
MPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQ

SEQ ID NO: 51977 - protein, 48 aa, Homo sapiens
  Payload ID: 10350
  Gene Symbol: MRPL28
  Gene Name: mitochondrial ribosomal protein L28
  ENSP ID: ENSP00000414038
MSRAGGRGEQSRWGRRAELRGLGRPEAPLRLGPDVCGSVPCARGAGSE

SEQ ID NO: 51978 - protein, 348 aa, Homo sapiens [sequence omitted]

SEQ ID NO: 51979 - protein, 375 aa, Homo sapiens
  Payload ID: 10351
  Gene Symbol: MRPL3
  Gene Name: mitochondrial ribosomal protein L3
  ENSP ID: ENSP00000398536
MPGWRLLTQVGAQVLGRLGDGLGAALGPGNRVTTNSLNVSLIRRNVGSEEKVGDLKKRTHIWLFVRGLHGKSGTWWDEHLSEENVPFIKQLVSDEDKAQLASKLCPLKDEPWPIHPWEPGSFRVGLIALKLGMMPLWTKDGQKHVVTLLQVQDCHVLKYTSKENCNGKMATLSVGGKTVSRFRKATSILEFYRELGLPPKQTVKIFNITDNAAIKPGTPLYAAHFRPGQYVDVTAKTIGKGFQGVMKRWGFKGQPATHGQTKTHRRPGAVATGDIGRVWPGTKMPGKMGNIYRTEYGLKVWRINTKHNIIYVNGSVPGHKNCLVKVKDSKLPAYKDLGKNLPFPTYFPDGDEEELPEDLYDENVCQPGAPSITFA

SEQ ID NO: 51980 - protein, 176 aa, Homo sapiens
  Payload ID: 10351
  Gene Symbol: MRPL3
  Gene Name: mitochondrial ribosomal protein L3
  ENSP ID: ENSP00000422035
MPGWRLLTQVGAQVLGRLGDGLGAALGPGNRTHIWLFVRGLHGKSGTWWDEHLSEENVPFIKQLVSDEDKAQLASKLCPLKDEPWPIHPWEPGSFRVGLIALKLGMMPLWTKDGQKHVVTLLQKATSILEFYRELGLPPKQTVKIFNITDNAAIKPGTPLYAAHFRPGQYVDVTAK

SEQ ID NO: 51981 - protein, 155 aa, Homo sapiens
  Payload ID: 10351
  Gene Symbol: MRPL3
  Gene Name: mitochondrial ribosomal protein L3
  ENSP ID: ENSP00000422419
MMPLWTKDGQKHVVTLLQVQDCHVLKYTSKENCNGKMATLSVGGKTVSRFRKATSILEFYRELGLPPKQTVKIFNITDNAAIKPGTPLYAAHFRPGQYVDVTAKTIGKGFQGVMKRWGFKGQPATHGQTKTHRRPGAVATGDIGRVWPGTKMPGK

SEQ ID NO: 51982 - protein, 28 aa, Homo sapiens
  Payload ID: 10351
  Gene Symbol: MRPL3
  Gene Name: mitochondrial ribosomal protein L3
  ENSP ID: ENSP00000422622
MMPLWTKDGQKHVVTLLQVQDCHVLKYT

SEQ ID NO: 51983 - protein, 363 aa, Homo sapiens
  Payload ID: 10351
  Gene Symbol: MRPL3
  Gene Name: mitochondrial ribosomal protein L3
  ENSP ID: ENSP00000424107
  MOD_RES (1)..(1): Any amino acid
XFFPSQRASAGDRSGGHCENFPTATASTWRWRGDSLKAERQGARKSTHIWLFVRGLHGKSGTWWDEHLSEENVPFIKQLVSDEDKAQLASKLCPLKDEPWPIHPWEPGSFRVGLIALKLGMMPLWTKDGQKHVVTLLQVQDCHVLKYTSKENCNGKMATLSVGGKTVSRFRKATSILEFYRELGLPPKQTVKIFNITDNAAIKPGTPLYAAHFRPGQYVDVTAKTIGKGFQGVMKRWGFKGQPATHGQTKTHRRPGAVATGDIGRVWPGTKMPGKMGNIYRTEYGLKVWRINTKHNIIYVNGSVPGHKNCLVKVKDSKLPAYKDLGKNLPFPTYFPDGDEEELPEDLYDENVCQPGAPSITFA

SEQ ID NO: 51984 - protein, 161 aa, Homo sapiens
  Payload ID: 10352
  Gene Symbol: MRPL30
  Gene Name: mitochondrial ribosomal protein L30
  Uniprot ID: Q8TCC3
  ENSP ID: ENSP00000338057
MAGILRLVVQWPPGRLQTVTKGVESLICTDWIRHKFTRSRIPEKVFQASPEDHEKYGGDPQNPHKLHIVTRIKSTRRRPYWEKDIIKMLGLEKAHTPQVHKNIPSVNAKLKVVKHLIRIKPLKLPQGLPAEENMSNTCLKSTGELVVQWHLKPVEQKAHES

SEQ ID NO: 51985 - protein, 161 aa, Homo sapiens; identical to SEQ ID NO: 51984
  Payload ID: 10352
  Gene Symbol: MRPL30
  Gene Name: mitochondrial ribosomal protein L30
  Uniprot ID: Q8TCC3
  ENSP ID: ENSP00000386752

SEQ ID NO: 51986 - protein, 101 aa, Homo sapiens
  Payload ID: 10352
  Gene Symbol: MRPL30
  Gene Name: mitochondrial ribosomal protein L30
  ENSP ID: ENSP00000386970
MAGILRLVVQWPPGRLQTVTKGVESLICTDWIRHKFTRSRIPEKVFQASPEDHEKYGGDPQNPHKLHIVTRIKSTRRRPYWEKDIIKMLGLEKVCNYFNHL

SEQ ID NO: 51987 - protein, 188 aa, Homo sapiens [sequence omitted]

SEQ ID NO: 51988 - protein, 42 aa, Homo sapiens
  Payload ID: 10353
  Gene Symbol: MRPL32
  Gene Name: mitochondrial ribosomal protein L32
  ENSP ID: ENSP00000391562
  MOD_RES (1)..(1): Any amino acid
XENSSLLDSIFWMAAPKNRRTIEVNRCRRRNPQKLIKVKSSC

SEQ ID NO: 51989 - protein, 107 aa, Homo sapiens
  Payload ID: 10353
  Gene Symbol: MRPL32
  Gene Name: mitochondrial ribosomal protein L32
  ENSP ID: ENSP00000415581
MALAMLVLVVSPWSAARGVLRNYWERLLRKLPQSRPGFPSPPWGPALAVQGPAMFTEPANDTSGSKENSSLLDSIFWMAAPKNRRTIEVNRCRRRNPQKLIKVKVMH

SEQ ID NO: 51990 - protein, 65 aa, Homo sapiens [sequence omitted]

SEQ ID NO: 51991 - protein, 54 aa, Homo sapiens
  Payload ID: 10354
  Gene Symbol: MRPL33
  Gene Name: mitochondrial ribosomal protein L33
  Uniprot ID: O75394
  ENSP ID: ENSP00000368988
MFLSAVFFAKSKSNETKSPLRGKEKNTLPLNGGLKMTLIYKEKTEGGDTDSEIL

SEQ ID NO: 51992 - protein, 69 aa, Homo sapiens
  Payload ID: 10354
  Gene Symbol: MRPL33
  Gene Name: mitochondrial ribosomal protein L33
  ENSP ID: ENSP00000407385
MFLSAVFFAKSKSKLWLWFLEDHRGEMSFSSHHIKGTYDQHDFLLMVLTLVTWLSGDLQVKLKCPQKWP

SEQ ID NO: 51993 - protein, 92 aa, Homo sapiens [sequence omitted]

SEQ ID NO: 51994 - protein, 92 aa, Homo sapiens [sequence omitted]

SEQ ID NO: 51995 - protein, 36 aa, Homo sapiens
  Payload ID: 10355
  Gene Symbol: MRPL34
  Gene Name: mitochondrial ribosomal protein L34
  ENSP ID: ENSP00000471089
MAVLAGSLLGPTSRLAGMSISRATSNARTSTAGSGA

SEQ ID NO: 51996 - protein, 92 aa, Homo sapiens [sequence omitted]

SEQ ID NO: 51997 - protein, 184 aa, Homo sapiens
  Payload ID: 10355
  Gene Symbol: MRPL34
  Gene Name: mitochondrial ribosomal protein L34
  ENSP ID: ENSP00000472266
MPRRPSGYFLSSGGAGSGSGRALGEGSGSQSRNSWSSVLTVSGHSSITMWLPSSMSFRNARSRICRRRRAQGLERLWAPESPAAGTAGPTADMAVLAGSLLGPTSRSAALLGGRWLQPRAWLGFPDAWGLPTPQQARGKARGNEYQPSNIKRKNKHGWVRRLSTPAGVQVILRRMLKGRKSLSH

SEQ ID NO: 51998 - protein, 170 aa, Homo sapiens
  Payload ID: 10356
  Gene Symbol: MRPL35
  Gene Name: mitochondrial ribosomal protein L35
  Uniprot ID: Q9NZE8
  ENSP ID: ENSP00000254644
MAASAFAGAVRAASGILRPLNILASSTYRNCVKNASLISALSTGRFSHIQTPVVSSTPRLTTSERNLTCGHTSVILNRMAPVLPSVLKLPVRSLTYFSARKGKRKTVKAVIDRFLRLHCGLWVRRKAGYKKKLWKKTPARKKRLREFVFCNKTQSKLLDKMTTSFWKRRN

SEQ ID NO: 51999 - protein, 188 aa, Homo sapiens [sequence omitted]

SEQ ID NO: 52000 - protein, 177 aa, Homo sapiens
  Payload ID: 10356
  Gene Symbol: MRPL35
  Gene Name: mitochondrial ribosomal protein L35
  ENSP ID: ENSP00000386255
MAASAFAGAVRAASGILRPLNILASSTYRNCVKNASLISALSTGRFSHIQTPVVSSTPRLTTSERNLTCGHTSVILNRMAPVLPSVLKLPVRSLTYFSARKGKRKTVKAVIDRFLRLHCGLWVRRKAGYKKKLWKKTPARKKRLREFVFCNKTQSKLLDKMTTSFWKRRNWHSPICR

SEQ ID NO: 52001 - protein, 95 aa, Homo sapiens
  Payload ID: 10356
  Gene Symbol: MRPL35
  Gene Name: mitochondrial ribosomal protein L35
  ENSP ID: ENSP00000473925
MAASAFAGAVRAASGILRPLNILASSTYRNCVKNASLISALSTGRFSHIQTPVVSSTPRLTTSERNLTCGHTSVILNRLAIRKNYGKRHLQGRSD

SEQ ID NO: 52002 - protein, 103 aa, Homo sapiens [sequence omitted]

SEQ ID NO: 52003 - protein, 103 aa, Homo sapiens [sequence omitted]

SEQ ID NO: 52004 - protein, 103 aa, Homo sapiens [sequence omitted]

SEQ ID NO: 52005 - protein, 35 aa, Homo sapiens
  Payload ID: 10357
  Gene Symbol: MRPL36
  Gene Name: mitochondrial ribosomal protein L36
  ENSP ID: ENSP00000424366
MANLFIRKMVNPLLYLSRHTVKPRALSTFLFGSIR

SEQ ID NO: 52006 - protein, 103 aa, Homo sapiens [sequence omitted]

SEQ ID NO: 52007 - protein, 292 aa, Homo sapiens
  Payload ID: 10358
  Gene Symbol: MRPL37
  Gene Name: mitochondrial ribosomal protein L37
  ENSP ID: ENSP00000338526
MSGACAPRGSRSLLPWIGCTRSLDWSPSPLRGRCTSCPGWRGRSFRPGTAATRTQGSTARPLFTSIRCTKTRPAISFTTVAAFSRSLLLQVRGSGGARLSTKDPLPTIASREEIEATKNHVLETFYPISPIIDLHECNIYDVKNDTGFQEGYPYPYPHTLYLLDKANLRPHRLQPDQLRAKMILFAFGSALAQARLLYGNDAKVLEQPVVVQSVGTDGRVFHFLVFQLNTTDLDCNEGVKNLAWVDSDQLLYQHFWCLPVIKKRVVVEPVGPVGFKPETFRKFLALYLHGAA

SEQ ID NO: 52008 - protein, 423 aa, Homo sapiens [sequence omitted]

SEQ ID NO: 52009 - protein, 264 aa, Homo sapiens
  Payload ID: 10358
  Gene Symbol: MRPL37
  Gene Name: mitochondrial ribosomal protein L37
  ENSP ID: ENSP00000392216
  MOD_RES (1)..(1): Any amino acid
XSLLLQVRGSGGARLSTKDPLPTIASREEIEATKNHVLETFYPISPIIDLHECNIYDVKNDTGFQEGYPYPYPHTLYLLDKANLRPHRLQPDQLRAKMILFAFGSALAQARLLYGNDAKVLEQPVVVQSVGTDGRVFHFLVFQLNTTDLDCNEGVKNLAWVDSDQLLYQHFWCLPVIKKRVVVTGPCFSKSQMSTSFVLTPSFNAGEEVMQRNLRASASLPPSTGSPASELVKEQEHAAGRVLRRVMLDSETPREELPAADFWK

SEQ ID NO: 52010 - protein, 483 aa, Homo sapiens
  Payload ID: 10358
  Gene Symbol: MRPL37
  Gene Name: mitochondrial ribosomal protein L37
  ENSP ID: ENSP00000473980
MALASGPARRALAGSGQLGLGGFGAPRRGAYEWGVRSTRKSEPPPLDRVYEIPGLEPITFAGKMHFVPWLARPIFPPWDRGYKDPRFYRSPPLHEHPLYKDQACYIFHHRCRLLEGVKQALWLTKTKLIEGLPEKVLSLVDDPRNHIENQDECVLNVISHARLWQTTEEIPKRETYCPVIVDNLIQLCKSQILKHPSLARRICVQNSTFSATWNRESLLLQVRGSGGARLSTKDPLPTIASREEIEATKNHVLETFYPISPIIDLHECNIYDVKNDTGFQEGYPYPYPHTLYLLDKANLRPHRLQPDQLRAKMILFAFGSALAQARLLYGNDAKVLEQPVVVQSVGTDGRVFHFLVFQLNTTDLDCNEGVKNLAWVDSDQLLYQHFWCLPVIKKRVVVKNKRHSSGPKCVCKTRNGKWLLDGPQIFKVRWIPSLPTHLPPRPSRLHKNTEFAGPGKEGRRLKHKTSCYAPGTKTVPKKSPCIL

SEQ ID NO: 52011 - protein, 380 aa, Homo sapiens [sequence omitted]

SEQ ID NO: 52012 - protein, 338 aa, Homo sapiens [sequence omitted]

SEQ ID NO: 52013 - protein, 353 aa, Homo sapiens
  Payload ID: 10360
  Gene Symbol: MRPL39
  Gene Name: mitochondrial ribosomal protein L39
  Uniprot ID: Q9NYK5
  ENSP ID: ENSP00000305682
MEALAMGSRALRLWLVAPGGGIKWRFIATSSASQLSPTELTEMRNDLFNKEKARQLSLTPRTEKIEVKHVGKTDPGTVFVMNKNISTPYSCAMHLSEWYCRKSILALVDGQPWDMYKPLTKSCEIKFLTFKDCDPGEVNKAYWRSCAMMMGCVIERAFKDEYMVNLVRAPEVPVISGAFCYDVVLDSKLDEWMPTKENLRSFTKDAHALIYKDLPFETLEVEAKVALEIFQHSKYKVDFIEEKASQNPERIVKLHRIGDFIDVSEGPLIPRTSICFQYEVSAVHNLQPTQPSLIRRFQGVSLPVHLRAHFTIWDKLLERSRKMTPFPILLLFTTQSFFTTSPESYLLHGTVSE

SEQ ID NO: 52014 - protein, 297 aa, Homo sapiens
  Payload ID: 10360
  Gene Symbol: MRPL39
  Gene Name: mitochondrial ribosomal protein L39
  ENSP ID: ENSP00000404426
MEALAMGSRALRLWLVAPGGGIKWRFIATSSASQLSPTELTEMRNDLFNKEKARQLSLTPRTEKIEVKHVGKTDPGTVFVMNKNISTPYSCAMHLSEWYCRKSILALVDGQPWDMYKPLTKSCEIKFLTFKDCDPGEVNKAYWRSCAMMMGCVIERAFKDEYMVNLVRAPEVPVLDSKLDEWMPTKENLRSFTKDAHALIYKDLPFETLEVEAKVALEIFQHSKYKVDFIEEKASQNPERIVKLHRIGDFIDVSEGPLIPRTSICFQYEVSAVHNLQPTQPSLIRRFQGVSLPVHLR

SEQ ID NO: 52015 - protein, 311 aa, Homo sapiens [sequence omitted]

SEQ ID NO: 52016 - protein, 311 aa, Homo sapiens [sequence omitted]

SEQ ID NO: 52017 - protein, 357 aa, Homo sapiens
  Payload ID: 10361
  Gene Symbol: MRPL4
  Gene Name: mitochondrial ribosomal protein L4
  ENSP ID: ENSP00000377334
MLQFVRAGARAWLRPTGSQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDLTHEEMPQSIVEATSRLKTFNLIPAVATRWRHEPKSSPVPQPTPLAGFPTSLRMKAQVIRVARQALHDVPRHLPALPSFALGLPHQNGSQESQPGTGPSLALGQQVMSWEQLLGQRLTGNKRPGRVWPRAAGLTKSH

SEQ ID NO: 52018 - protein, 119 aa, Homo sapiens
  Payload ID: 10361
  Gene Symbol: MRPL4
  Gene Name: mitochondrial ribosomal protein L4
  ENSP ID: ENSP00000465050
QKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDL

SEQ ID NO: 52019 - protein, 263 aa, Homo sapiens
  Payload ID: 10361
  Gene Symbol: MRPL4
  Gene Name: mitochondrial ribosomal protein L4
  Uniprot ID: Q9BYD3
  ENSP ID: ENSP00000465143
MLQFVRAGARAWLRPTGSQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDLTHEEMPQSIVEATSRLKTFNLIPAVGEQRAQAPRVRMCRLRC

SEQ ID NO: 52020 - protein, 127 aa, Homo sapiens
  Payload ID: 10361
  Gene Symbol: MRPL4
  Gene Name: mitochondrial ribosomal protein L4
  ENSP ID: ENSP00000465635
MLQFVRAGARAWLRPTGSQGLSSLAEEAARATENPEQVASEGLPEPVLRKVELPVPTHRRPVQAWVESLRGFEQERVGLADLHPDVFATAPRLDILHQVAMWQKNFKRIEVLPMAPGAPQVTTTCCP

SEQ ID NO: 52021 - protein, 163 aa, Homo sapiens
  Payload ID: 10361
  Gene Symbol: MRPL4
  Gene Name: mitochondrial ribosomal protein L4
  ENSP ID: ENSP00000466050
MLQFVRAGARAWLRPTGSQGSSLTFAQPLQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVA

SEQ ID NO: 52022 - protein, 220 aa, Homo sapiens
  Payload ID: 10361
  Gene Symbol: MRPL4
  Gene Name: mitochondrial ribosomal protein L4
  ENSP ID: ENSP00000466169
MKFGGVQGSSLTFAQPLQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDL

SEQ ID NO: 52023 - protein, 300 aa, Homo sapiens
  Payload ID: 10361
  Gene Symbol: MRPL4
  Gene Name: mitochondrial ribosomal protein L4
  ENSP ID: ENSP00000468569
MLQFVRAGARAWLRPTGSQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDLTHEEMPQSIVEATSRLKTFNLIPAVGLNVHSMLKHQTLVLTLPTVAFLEDKLLWQDSRYRPLYPFSLPYSDFPRPLPHA

SEQ ID NO: 52024 - protein, 206 aa, Homo sapiens [sequence omitted]

SEQ ID NO: 52025 - protein, 137 aa, Homo sapiens [sequence omitted]

SEQ ID NO: 52026 - protein, 51 aa, Homo sapiens
  Payload ID: 10364
  Gene Symbol: MRPL42
  Gene Name: mitochondrial ribosomal protein L42
  ENSP ID: ENSP00000351506
MAVAAVKWVMSKRTILKHLFPVQNSGVHVQVCYVDVLHILRFGLQLNPSPK

SEQ ID NO: 52027 - protein, 139 aa, Homo sapiens
  Payload ID: 10364
  Gene Symbol: MRPL42
  Gene Name: mitochondrial ribosomal protein L42
  ENSP ID: ENSP00000376836
MAVAAVKWVMSKRTILKHLFPVQNGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGRCRKNLNPPKDR

SEQ ID NO: 52028 - protein, 142 aa, Homo sapiens
  Payload ID: 10364
  Gene Symbol: MRPL42
  Gene Name: mitochondrial ribosomal protein L42
  Uniprot ID: Q9Y6G3
  ENSP ID: ENSP00000447547
MAVAAVKWVMSKRTILKHLFPVQNGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGRYHRCRKNLNPPKDR

SEQ ID NO: 52029 - protein, 142 aa, Homo sapiens; identical to SEQ ID NO: 52028
  Payload ID: 10364
  Gene Symbol: MRPL42
  Gene Name: mitochondrial ribosomal protein L42
  Uniprot ID: Q9Y6G3
  ENSP ID: ENSP00000449392

SEQ ID NO: 52030 - protein, 142 aa, Homo sapiens; identical to SEQ ID NO: 52028
  Payload ID: 10364
  Gene Symbol: MRPL42
  Gene Name: mitochondrial ribosomal protein L42
  Uniprot ID: Q9Y6G3
  ENSP ID: ENSP00000449884

SEQ ID NO: 52031 - protein, 53 aa, Homo sapiens
  Payload ID: 10364
  Gene Symbol: MRPL42
  Gene Name: mitochondrial ribosomal protein L42
  ENSP ID: ENSP00000449886
MAVAAVKWVMSKRTILKHLFPVQNSGVHVQMELYIVFVINLRILLYQMTIIAT

SEQ ID NO: 52032 - protein, 155 aa, Homo sapiens
  Payload ID: 10364
  Gene Symbol: MRPL42
  Gene Name: mitochondrial ribosomal protein L42
  ENSP ID: ENSP00000473798
MAVAAVKWVMSKRTILKHLFPVQNGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGRGKVSLTVLRRLILNSWTQVILLPQLGL

SEQ ID NO: 52033 - protein, 128 aa, Homo sapiens
  Payload ID: 10364
  Gene Symbol: MRPL42
  Gene Name: mitochondrial ribosomal protein L42
  ENSP ID: ENSP00000473958
MAVAAVKWVMSKRTILKHLFPVQNGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGR

SEQ ID NO: 52034 - protein, 202 aa, Homo sapiens
  Payload ID: 10365
  Gene Symbol: MRPL43
  Gene Name: mitochondrial ribosomal protein L43
  Uniprot ID: Q8N983
  ENSP ID: ENSP00000299179
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDTGLRLSAVAPQILLPGWPDPISVQSSDLPWGNTHYRPEPLSSTTWL

SEQ ID NO: 52035 - protein, 215 aa, Homo sapiens
  Payload ID: 10365
  Gene Symbol: MRPL43
  Gene Name: mitochondrial ribosomal protein L43
  Uniprot ID: Q8N983
  ENSP ID: ENSP00000315364
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDTGLRLSAVAPQILLPGWPDPPDLPTVDPISSSLTSAPAPMLSAVSCLPIVPALTTVCSA

SEQ ID NO: 52036 - protein, 159 aa, Homo sapiens
  Payload ID: 10365
  Gene Symbol: MRPL43
  Gene Name: mitochondrial ribosomal protein L43
  Uniprot ID: Q8N983
  ENSP ID: ENSP00000315948
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQVQAQ

SEQ ID NO: 52037 - protein, 235 aa, Homo sapiens
  Payload ID: 10365
  Gene Symbol: MRPL43
  Gene Name: mitochondrial ribosomal protein L43
  Uniprot ID: Q8N983
  ENSP ID: ENSP00000339844
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDAAEFLGEGAGPCWYSIVALPQKHIAIAIHPPQPAGQCHQAIGHWPETVCSCTADPPARLARPNISSVIRSSLGKYPLPS

SEQ ID NO: 52038 - protein, 164 aa, Homo sapiens
  Payload ID: 10365
  Gene Symbol: MRPL43
  Gene Name: mitochondrial ribosomal protein L43
  Uniprot ID: Q8N983
  ENSP ID: ENSP00000359254
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQCLLLGAVTL

SEQ ID NO: 52039 - protein, 159 aa, Homo sapiens; identical to SEQ ID NO: 52036
  Payload ID: 10365
  Gene Symbol: MRPL43
  Gene Name: mitochondrial ribosomal protein L43
  Uniprot ID: Q8N983
  ENSP ID: ENSP00000359256

SEQ ID NO: 52040 - protein, 184 aa, Homo sapiens
  Payload ID: 10365
  Gene Symbol: MRPL43
  Gene Name: mitochondrial ribosomal protein L43
  ENSP ID: ENSP00000359261
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDTGLRLSAVAPQILLPGWPDPTRATRATR

SEQ ID NO: 52041 - protein, 261 aa, Homo sapiens
  Payload ID: 10365
  Gene Symbol: MRPL43
  Gene Name: mitochondrial ribosomal protein L43
  Uniprot ID: Q8N983
  ENSP ID: ENSP00000359262
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDAAEFLGEGAGPCWYSIVALPQKHIAIAIHPPQPAGQCHQAIGHWPETVCSCTADPPARLARPTRPPHSGSYLILIDLCSSPYAVRSFLPPDCPCTDHCVLSVKAA

SEQ ID NO: 52042 - protein, 169 aa, Homo sapiens
  Payload ID: 10365
  Gene Symbol: MRPL43
  Gene Name: mitochondrial ribosomal protein L43
  ENSP ID: ENSP00000408806
  MOD_RES (1)..(1): Any amino acid
XGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDAAEFLGEGAGPCWTLA

SEQ ID NO: 52043 - protein, 148 aa, Homo sapiens
  Payload ID: 10365
  Gene Symbol: MRPL43
  Gene Name: mitochondrial ribosomal protein L43
  ENSP ID: ENSP00000430369
  MOD_RES (1)..(1): Any amino acid
XEFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDTGLRLSAVAPQILLPGWPDPLEDKLSFDPAGRRET

SEQ ID NO: 52044 - protein, 44 aa, Homo sapiens
  Payload ID: 10365
  Gene Symbol: MRPL43
  Gene Name: mitochondrial ribosomal protein L43
  ENSP ID: ENSP00000471004
MTARGTPSRFLASVLHNGLGRYVQQLQRLSFSVSRDGASSRGAS

SEQ ID NO: 52045 - protein, 332 aa, Homo sapiens
  Payload ID: 10366
  Gene Symbol: MRPL44
  Gene Name: mitochondrial ribosomal protein L44
  Uniprot ID: Q9H9J2
  ENSP ID: ENSP00000258383
MASGLVRLLQQGHRCLLAPVAPKLVPPVRGVKKGFRAAFRFQKELERQRLLRCPPPPVRRSEKPNWDYHAEIQAFGHRLQENFSLDLLKTAFVNSCYIKSEEAKRQQLGIEKEAVLLNLKSNQELSEQGTSFSQTCLTQFLEDEYPDMPTEGIKNLVDFLTGEEVVCHVARNLAVEQLTLSEEFPVPPAVLQQTFFAVIGALLQSSGPERTALFIRDFLITQMTGKELFEMWKIINPMGLLVEELKKRNVSAPESRLTRQSGGTTALPLYFVGLYCDKKLIAEGPGETVLVAEEEAARVALRKLYGFTENRRPWNYSKPKETLRAEKSITAS

SEQ ID NO: 52046 - protein, 256 aa, Homo sapiens
  Payload ID: 10367
  Gene Symbol: MRPL45
  Gene Name: mitochondrial ribosomal protein L45
  ENSP ID: ENSP00000478397
MAAPIPQGFSCLSRFLGWWSRQPVLVTQSAAIVPVRTKKRFTPPIYQPKFKTEKEFMQHARKAGLVIPPEKSDRSIHLACTAGIFDAYVPPEGDARISSLSKEGLIERTERMKKTMASQVSIRRIKDYDANFKIKDFPEKAKDIFIEAHLCLNNSDHDRLHTLVTEHCFPTLAIYDRFGRLMYGQEDVPKDVLEYVVFEKQLTNPYGSWRMHTKIVPPWAPPKQPILKTVMIPGPQLKPEEEYEEAQGEAQKPQLA

SEQ ID NO: 52047 - protein, 256 aa, Homo sapiens
  Payload ID: 10367
  Gene Symbol: MRPL45
  Gene Name: mitochondrial ribosomal protein L45
  ENSP ID: ENSP00000479891
MAAPIPQGFSCLSRFLGWWFRQPVLVTQSAAIVPVRTKKRFTPPIYQPKFKTEKEFMQHARKAGLVIPPEKSDRSIHLACTAGIFDAYVPPEGDARISSLSKEGLIERTERMKKTMASQVSIRRIKDYDANFKIKDFPEKAKDIFIEAHLCLNNSDHDRLHTLVTEHCFPTLAIYDRFGRLMYGQEDVPKDVLEYVVFEKQLTNPYGSWRMHTKIVPPWAPPKQPILKTVMIPGPQLKPEEEYEEAQGEAQKPQLA

SEQ ID NO: 52048 - protein, 306 aa, Homo sapiens [sequence omitted]

SEQ ID NO: 52049 - protein, 306 aa, Homo sapiens
  Payload ID: 10367
  Gene Symbol: MRPL45
  Gene Name: mitochondrial ribosomal protein L45
  ENSP ID: ENSP00000484903
MAAPIPQGFSCLSRFLGWWSRQPVLVTQSAAIVPVRTKKRFTPPIYQPKFKTEKEFMQHARKAGLVIPPEKSDRSIHLACTAGIFDAYVPPEGDARISSLSKEGLIERTERMKKTMASQVSIRRIKDYDANFKIKDFPEKAKDIFIEAHLCLNNSDHDRLHTLVTEHCFPDMTWDIKYKTVRWSFVESLEPSHVVQVRCSSMMNQGNVYGQITVRMHTRQTLAIYDRFGRLMYGQEDVPKDVLEYVVFEKQLTNPYGSWRMHTKIVPPWAPPKQPILKTVMIPGPQLKPEEEYEEAQGEAQKPQLA

SEQ ID NO: 52050 - protein, 279 aa, Homo sapiens [sequence omitted]

SEQ ID NO: 52051 - protein, 86 aa, Homo sapiens
  Payload ID: 10368
  Gene Symbol: MRPL46
  Gene Name: mitochondrial ribosomal protein L46
  ENSP ID: ENSP00000453881
MAAPVRRTLLGVAGGWRRFERLWAGSLSSRSLALAAAPSSNGSPWRLLGALCLQRPPVVSKPLTPLQEEMASLLQQKLMKRMTEHP

SEQ ID NO: 52052 - protein, 45 aa, Homo sapiens
  Payload ID: 10368
  Gene Symbol: MRPL46
  Gene Name: mitochondrial ribosomal protein L46
  ENSP ID: ENSP00000477583
  MOD_RES (1)..(1): Any amino acid
XVREKFGDQDVWILPQAEWQPGETLRGTAERTLATLSGDTHFKGG

SEQ ID NO: 52053 - protein, 169 aa, Homo sapiens
  Payload ID: 10368
  Gene Symbol: MRPL46
  Gene Name: mitochondrial ribosomal protein L46
  ENSP ID: ENSP00000477676
MAAPVRRTLLGVAGGWRRFERLWAGSLSSRSLALAAAPSSNGSPWRLLGALCLQRPPVVSKPLTPLQEEMASLLQQIEIERSLYSDHELRALDENQRLAKKKADLHDEEDEQDILLAQDLEDMWEQKFLQFKLGARITGCDPFRPARRKGKGVFGFPNKRQLLGPCFVF

SEQ ID NO: 52054 - protein, 230 aa, Homo sapiens
  Payload ID: 10369
  Gene Symbol: MRPL47
  Gene Name: mitochondrial ribosomal protein L47
  Uniprot ID: Q9HD33
  ENSP ID: ENSP00000259038
MAAAGLALLCRRVSSALKSSRSLITPQVPACTGLLHTTLSRKGLEEFFDDPKNWGQEKVKSGAAWTCQQLRNKSNEDLHKLWYVLLKERNMLLTLEQEAKRQRLPMPSPERLDKVVDSMDALDKVVQEREDALRLLQTGQERARPGAWRRDIFGRIIWHKFKQWVIPWHLNKRYNRKRFFALPYVDHFLRLEREKRARIKARKENLERKKAKILLKKFPHLAEAQKSSLV

SEQ ID NO: 52055 - protein, 140 aa, Homo sapiens
  Payload ID: 10369
  Gene Symbol: MRPL47
  Gene Name: mitochondrial ribosomal protein L47
  Uniprot ID: Q9HD33
  ENSP ID: ENSP00000376427
MLLTLEQEAKRQRLPMPSPERLDKVVDSMDALDKVVQEREDALRLLQTGQERARPGAWRRDIFGRIIWHKFKQWVIPWHLNKRYNRKRFFALPYVDHFLRLEREKRARIKARKENLERKKAKILLKKFPHLAEAQKSSLV

SEQ ID NO: 52056 - protein, 250 aa, Homo sapiens
  Payload ID: 10369
  Gene Symbol: MRPL47
  Gene Name: mitochondrial ribosomal protein L47
  Uniprot ID: Q9HD33
  ENSP ID: ENSP00000417602
MAAAGLALLCRRVSSALKSSRSLITPQVPACTGFFLSLLPKSTPNVTSFHQYRLLHTTLSRKGLEEFFDDPKNWGQEKVKSGAAWTCQQLRNKSNEDLHKLWYVLLKERNMLLTLEQEAKRQRLPMPSPERLDKVVDSMDALDKVVQEREDALRLLQTGQERARPGAWRRDIFGRIIWHKFKQWVIPWHLNKRYNRKRFFALPYVDHFLRLEREKRARIKARKENLERKKAKILLKKFPHLAEAQKSSLV

SEQ ID NO: 52057 - protein, 212 aa, Homo sapiens [sequence omitted]

SEQ ID NO: 52058 - protein, 113 aa, Homo sapiens
  Payload ID: 10370
  Gene Symbol: MRPL48
  Gene Name: mitochondrial ribosomal protein L48
  ENSP ID: ENSP00000321539
MTLAESYAQYVHNLCNSLSIKVEESYAMPTKTIEVLQLQDQGSKMLLDSVLTTHERVVQISGLSATFAEIFLEIIQSSLPEGVRLSVKEHTEEDFKGRFKARPELEELLAKLK

SEQ ID NO: 52059 - protein, 113 aa, Homo sapiens; identical to SEQ ID NO: 52058
  Payload ID: 10370
  Gene Symbol: MRPL48
  Gene Name: mitochondrial ribosomal protein L48
  ENSP ID: ENSP00000381497

SEQ ID NO: 52060 - protein, 113 aa, Homo sapiens; identical to SEQ ID NO: 52058
  Payload ID: 10370
  Gene Symbol: MRPL48
  Gene Name: mitochondrial ribosomal protein L48
  ENSP ID: ENSP00000399076

SEQ ID NO: 52061 - protein, 26 aa, Homo sapiens
  Payload ID: 10370
  Gene Symbol: MRPL48
  Gene Name: mitochondrial ribosomal protein L48
  ENSP ID: ENSP00000439573
MTLAESYAQYVHNLCNSLSIKVEERY

SEQ ID NO: 52062 - protein, 10 aa, Homo sapiens
  Payload ID: 10370
  Gene Symbol: MRPL48
  Gene Name: mitochondrial ribosomal protein L48
  ENSP ID: ENSP00000439632
MTLAESYAQY

SEQ ID NO: 52063 - protein, 52 aa, Homo sapiens
  Payload ID: 10370
  Gene Symbol: MRPL48
  Gene Name: mitochondrial ribosomal protein L48
  ENSP ID: ENSP00000441925
MSGTLEKVLCLRNNTIFKQAFSLLRFRTSGEKPIYSVERDGLACGPGLSTVA

SEQ ID NO: 52064 - protein, 50 aa, Homo sapiens
  Payload ID: 10370
  Gene Symbol: MRPL48
  Gene Name: mitochondrial ribosomal protein L48
  ENSP ID: ENSP00000442146
MSGTLEKVLCLRNNTIFKQAFSLLRWNSTKYQSALQDKAHPRHWKVQALN

SEQ ID NO: 52065 - protein, 50 aa, Homo sapiens
  Payload ID: 10370
  Gene Symbol: MRPL48
  Gene Name: mitochondrial ribosomal protein L48
  ENSP ID: ENSP00000442878
MSGTLEKVLCLRNNTIFKQAFSLLRFRTSGEKPIYSVAQEEEGKSGSESH

SEQ ID NO: 52066 - protein, 121 aa, Homo sapiens
  Payload ID: 10370
  Gene Symbol: MRPL48
  Gene Name: mitochondrial ribosomal protein L48
  ENSP ID: ENSP00000443685
MSGTLEKVLCLRNNTIFKQAFSLLRFRTSGEKPIYSVGGILLSISRPYKTKPTHGIGKYKHLIKAEEISGLSATFAEIFLEIIQSSLPEGVRLSVKEHTEEDFKGRFKARPELEELLAKLK

SEQ ID NO: 52067 - protein, 50 aa, Homo sapiens; identical to SEQ ID NO: 52064
  Payload ID: 10370
  Gene Symbol: MRPL48
  Gene Name: mitochondrial ribosomal protein L48
  ENSP ID: ENSP00000444441

SEQ ID NO: 52068 - protein, 41 aa, Homo sapiens
  Payload ID: 10370
  Gene Symbol: MRPL48
  Gene Name: mitochondrial ribosomal protein L48
  ENSP ID: ENSP00000445111
MSGTLEKVLCLRNNTIFKQAFSLLRFRTSGEKPIYSVDGTV

SEQ ID NO: 52069 - protein, 13 aa, Homo sapiens
  Payload ID: 10370
  Gene Symbol: MRPL48
  Gene Name: mitochondrial ribosomal protein L48
  ENSP ID: ENSP00000446144
MTLAESYAQYVHN

SEQ ID NO: 52070 - protein, 166 aa, Homo sapiens
  Payload ID: 10371
  Gene Symbol: MRPL49
  Gene Name: mitochondrial ribosomal protein L49
  Uniprot ID: Q13405
  ENSP ID: ENSP00000279242
MAATMFRATLRGWRTGVQRGCGLRLLSQTQGPPDYPRFVESVDEYQFVERLLPATRIPDPPKHEHYPTPSGWQPPRDPPPNLPYFVRRSRMHNIPVYKDITHGNRQMTVIRKVEGDIWALQKDVEDFLSPLLGKTPVTQVNEVTGTLRIKGYFDQELKAWLLEKGF

SEQ ID NO: 52071 - protein, 127 aa, Homo sapiens
  Payload ID: 10371
  Gene Symbol: MRPL49
  Gene Name: mitochondrial ribosomal protein L49
  ENSP ID: ENSP00000434052
  MOD_RES (1)..(1): Any amino acid
XTMFRATLRGWRTGVQRGCGLRLLVRALSEELRASRGYPPPNLPYFVRRSRMHNIPVYKDITHGNRQMTVIRKVEGDIWALQKDVEDFLSPLLGKTPVTQVNEVTGTLRIKGYFDQELKAWLLEKGF

SEQ ID NO: 52072 - protein, 166 aa, Homo sapiens; identical to SEQ ID NO: 52070
  Payload ID: 10371
  Gene Symbol: MRPL49
  Gene Name: mitochondrial ribosomal protein L49
  Uniprot ID: Q13405
  ENSP ID: ENSP00000434190

SEQ ID NO: 52073 - protein, 56 aa, Homo sapiens
  Payload ID: 10371
  Gene Symbol: MRPL49
  Gene Name: mitochondrial ribosomal protein L49
  ENSP ID: ENSP00000434222
MAATMFRATLRGWRTGVQRGCGLRLLTPHPTCLTLYDALGCTTSPSTRTSRMATGR

SEQ ID NO: 52074 - protein, 99 aa, Homo sapiens
  Payload ID: 10371
  Gene Symbol: MRPL49
  Gene Name: mitochondrial ribosomal protein L49
  ENSP ID: ENSP00000436740
MAATMFRATLRGWRTGVQRGCGLRLLSQTQGPPDYPRFVESVDEYQFVERLLPATRIPDPPKHEHYPTPSGWQPPRDPTLPPNWLRQLSVPDSPTWSLP

SEQ ID NO: 52075 - protein, 140 aa, Homo sapiens
  Payload ID: 10371
  Gene Symbol: MRPL49
  Gene Name: mitochondrial ribosomal protein L49
  ENSP ID: ENSP00000437177
MAATMFRATLRGWRTGVQRGCGLRLLSQTQGPPDYPRFVESVDEYQFVERLLPATRIPDPPKHEHYPTPSGWQPPRDPPPNLPYFVRRSRMHNIPVYKDITHGNRQMTVIRKVEGDIWVSGWVGLGLGLTLSGLKGQESF

SEQ ID NO: 52076 - protein, 158 aa, Homo sapiens
  Payload ID: 10372
  Gene Symbol: MRPL50
  Gene Name: mitochondrial ribosomal protein L50
  Uniprot ID: Q8N5N7
  ENSP ID: ENSP00000363999
MAARSVSGITRRVFMWTVSGTPCREFWSRFRKEKEPVVVETVEEKKEPILVCPPLRSRAYTPPEDLQSRLESYVKEVFGSSLPSNWQDISLEDSRLKFNLLAHLADDLGHVVPNSRLHQMCRVRDVLDFYNVPIQDRSKFDELSASNLPPNLKITWSY

SEQ ID NO: 52077 - protein, 128 aa, Homo sapiens
  Payload ID: 10373
  Gene Symbol: MRPL51
  Gene Name: mitochondrial ribosomal protein L51
  Uniprot ID: Q4U2R6
  ENSP ID: ENSP00000229238
MAGNLLSGAGRRLWDWVPLACRSFSLGVPRLIGIRLTLPPPKVVDRWNEKRAMFGVYDNIGILGNFEKHPKELIRGPIWLRGWKGNELQRCIRKRKMVGSRMFADDLHNLNKRIRYLYKHFNRHGKFR

SEQ ID NO: 52078 - protein, 32 aa, Homo sapiens
  Payload ID: 10373
  Gene Symbol: MRPL51
  Gene Name: mitochondrial ribosomal protein L51
  ENSP ID: ENSP00000471687
MVGSRMFADDLHNLNKRIRYLYKHFNRHGKFR

SEQ ID NO: 52079 - protein, 76 aa, Homo sapiens
  Payload ID: 10373
  Gene Symbol: MRPL51
  Gene Name: mitochondrial ribosomal protein L51
  ENSP ID: ENSP00000477598
MFGVYDNIGILGNFEKHPKELIRGPIWLRGWKGNELQRCIRKRKMVGSRMFADDLHNLNKRIRYLYKHFNRHGKFR

SEQ ID NO: 52080 - protein, 76 aa, Homo sapiens; identical to SEQ ID NO: 52079
  Payload ID: 10373
  Gene Symbol: MRPL51
  Gene Name: mitochondrial ribosomal protein L51
  ENSP ID: ENSP00000478132

SEQ ID NO: 52081 - protein, 73 aa, Homo sapiens
  Payload ID: 10373
  Gene Symbol: MRPL51
  Gene Name: mitochondrial ribosomal protein L51
  ENSP ID: ENSP00000478326
MFGVYDNIGILGNFEKHPKELIRGPIWLRGWKGNELQRCIRKRKMVGSRMFADDLHNLNKRIRYLYKHFNRHG

SEQ ID NO: 52082 - protein, 76 aa, Homo sapiens; identical to SEQ ID NO: 52079
  Payload ID: 10373
  Gene Symbol: MRPL51
  Gene Name: mitochondrial ribosomal protein L51
  ENSP ID: ENSP00000480329

SEQ ID NO: 52083 - protein, 76 aa, Homo sapiens; identical to SEQ ID NO: 52079
  Payload ID: 10373
  Gene Symbol: MRPL51
  Gene Name: mitochondrial ribosomal protein L51
  ENSP ID: ENSP00000482353

SEQ ID NO: 52084 - protein, 52 aa, Homo sapiens
  Payload ID: 10374
  Gene Symbol: MRPL52
  Gene Name: mitochondrial ribosomal protein L52
  ENSP ID: ENSP00000310762
MVKIFSTCYLLDELYCCHRKWTLDYKHGSSGSRSCRKNKGSRKMLLNPKGLH

SEQ ID NO: 52085 - protein, 123 aa, Homo sapiens
  Payload ID: 10374
  Gene Symbol: MRPL52
  Gene Name: mitochondrial ribosomal protein L52
  Uniprot ID: Q86TS9
  ENSP ID: ENSP00000347277
MAALGTVLFTGVRRLHCSVAAWAGGQWRLQQGLAANPSGYGPLTELPDWSYADGRPAPPMKGQLRRKAERETFARRVVLLSQEMDAGLQAWQLRQQKLQEEQRKQENALKPKGASLKSPLPSQ

SEQ ID NO: 52086 - protein, 122 aa, Homo sapiens
  Payload ID: 10374
  Gene Symbol: MRPL52
  Gene Name: mitochondrial ribosomal protein L52
  Uniprot ID: Q86TS9
  ENSP ID: ENSP00000380633
MAALGTVLFSVRRLHCSVAAWAGGQWRLQQGLAANPSGYGPLTELPDWSYADGRPAPPMKGQLRRKAERETFARRVVLLSQEMDAGLQAWQLRQQKLQEEQRKQENALKPKGASLKSPLPSQ

SEQ ID NO: 52087 - protein, 87 aa, Homo sapiens
  Payload ID: 10374
  Gene Symbol: MRPL52
  Gene Name: mitochondrial ribosomal protein L52
  Uniprot ID: Q86TS9
  ENSP ID: ENSP00000380642
MAALGTVLFTGVRRLHCSVAAWAGGQWRLQQGLAANPSGYGPLTELPDWSYAETSCTAVTGNGRWITSMAAQAAEVAGRTKEAGKCS

SEQ ID NO: 52088 - protein, 110 aa, Homo sapiens
  Payload ID: 10374
  Gene Symbol: MRPL52
  Gene Name: mitochondrial ribosomal protein L52
  ENSP ID: ENSP00000406655
MAALGTVLFSVRRLHCSVAAWAGGQWRLQQGLAANPSGYGPLTELPDWSYADGRPAPPMKGQLRRKAERETFAVSETSCTAVTGNGRWITSMAAQAAEVAGRTKEAGKCS

SEQ ID NO: 52089 - protein, 64 aa, Homo sapiens
  Payload ID: 10374
  Gene Symbol: MRPL52
  Gene Name: mitochondrial ribosomal protein L52
  Uniprot ID: Q86TS9
  ENSP ID: ENSP00000451081
MKGQLRRKAERETFARRVVLLSQEMDAGLQAWQLRQQKLQEEQRKQENALKPKGASLKSPLPSQ

SEQ ID NO: 52090 - protein, 64 aa, Homo sapiens; identical to SEQ ID NO: 52089
  Payload ID: 10374
  Gene Symbol: MRPL52
  Gene Name: mitochondrial ribosomal protein L52
  Uniprot ID: Q86TS9
  ENSP ID: ENSP00000451303

SEQ ID NO: 52091 - protein, 51 aa, Homo sapiens
  Payload ID: 10374
  Gene Symbol: MRPL52
  Gene Name: mitochondrial ribosomal protein L52
  ENSP ID: ENSP00000451436
MRRRVVLLSQEMDAGLQAWQLRQQKLQEEQRKQENALKPKGASLKSPLPSQ

SEQ ID NO: 52092 - protein, 64 aa, Homo sapiens; identical to SEQ ID NO: 52089
  Payload ID: 10374
  Gene Symbol: MRPL52
  Gene Name: mitochondrial ribosomal protein L52
  Uniprot ID: Q86TS9
  ENSP ID: ENSP00000451481

SEQ ID NO: 52093 - protein, 52 aa, Homo sapiens
  Payload ID: 10374
  Gene Symbol: MRPL52
  Gene Name: mitochondrial ribosomal protein L52
  ENSP ID: ENSP00000451809
MKGQLRRKAERETFAVSETSCTAVTGNGRWITSMAAQAAEVAGRTKEAGKCS

SEQ ID NO: 52094 - protein, 72 aa, Homo sapiens
  Payload ID: 10374
  Gene Symbol: MRPL52
  Gene Name: mitochondrial ribosomal protein L52
  ENSP ID: ENSP00000451832
MAALGTVLFSVRRLHCSVAAWAGGQWRLQQGLAANPSGYGPLTELPDWSYAETSCTAVTGNGRWITSMAAQA

SEQ ID NO: 52095 - protein, 112 aa, Homo sapiens
  Payload ID: 10375
  Gene Symbol: MRPL53
  Gene Name: mitochondrial ribosomal protein L53
  Uniprot ID: Q96EL3
  ENSP ID: ENSP00000258105
MAAALARLGLRPVKQVRVQFCPFEKNVESTRTFLQTVSSEKVRSTNLNCSVIADVRHDGSEPCVDVLFGDGHRLIMRGAHLTALEMLTAFASHIRARDAAGSGDKPGADTGR

SEQ ID NO: 52096 - protein, 70 aa, Homo sapiens
  Payload ID: 10375
  Gene Symbol: MRPL53
  Gene Name: mitochondrial ribosomal protein L53
  ENSP ID: ENSP00000386920
MAAALARLGLRPVKQVRVQFCPFEKNVESTRRRASPDYARRSSHRSGNAHRLRLPHPGQGRGGQRGQAGR

SEQ ID NO: 52097 - protein, 138 aa, Homo sapiens
  Payload ID: 10376
  Gene Symbol: MRPL54
  Gene Name: mitochondrial ribosomal protein L54
  Uniprot ID: Q6P161
  ENSP ID: ENSP00000331849
MATKRLFGATRTWAGWGAWELLNPATSGRLLARDYAKKPVMKGAKSGKGAVTSEALKDPDVCTDPVQLTTYAMGVNIYKEGQDVPLKPDAEYPEWLFEMNLGPPKTLEELDPESREYWRRLRKQNIWRHNRLSKNKRL

SEQ ID NO: 52098 - protein, 76 aa, Homo sapiens
  Payload ID: 10376
  Gene Symbol: MRPL54
  Gene Name: mitochondrial ribosomal protein L54
  ENSP ID: ENSP00000467023
  MOD_RES (1)..(1): Any amino acid
XTKRLFGATRTWAGWGAWELLNPATSGRLLARDYAKKPVHPLESAFGTLTLTQGLTLGLSEDWPPCSPNNSCPAWL

SEQ ID NO: 52099 - protein, 128 aa, Homo sapiens
  Payload ID: 10377
  Gene Symbol: MRPL55
  Gene Name: mitochondrial ribosomal protein L55
  Uniprot ID: Q7Z7F7
  ENSP ID: ENSP00000295008
MAAVGSLLGRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQFWTRTKK

SEQ ID NO: 52100 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000337342

SEQ ID NO: 52101 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000337361

SEQ ID NO: 52102 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000338189

SEQ ID NO: 52103 - protein, 55 aa, Homo sapiens
  Payload ID: 10377
  Gene Symbol: MRPL55
  Gene Name: mitochondrial ribosomal protein L55
  ENSP ID: ENSP00000355692
MLAMPIDLDTLSPEERRARLRKREAQLQSRKEYEQELSDDLHVERYRQFWTRTKK

SEQ ID NO: 52104 - protein, 55 aa, Homo sapiens; identical to SEQ ID NO: 52103
  Payload ID: 10377
  Gene Symbol: MRPL55
  Gene Name: mitochondrial ribosomal protein L55
  ENSP ID: ENSP00000355693

SEQ ID NO: 52105 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000355694

SEQ ID NO: 52106 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000355695

SEQ ID NO: 52107 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000355696

SEQ ID NO: 52108 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000355697

SEQ ID NO: 52109 - protein, 164 aa, Homo sapiens
  Payload ID: 10377
  Gene Symbol: MRPL55
  Gene Name: mitochondrial ribosomal protein L55
  Uniprot ID: Q7Z7F7
  ENSP ID: ENSP00000355699
MAAVGSLLGLAASSWLGGQNASDHSLWLLRKPRGSSCPGTGHQLCRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQFWTRTKK

SEQ ID NO: 52110 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000355700

SEQ ID NO: 52111 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000355701

SEQ ID NO: 52112 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000355702

SEQ ID NO: 52113 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000355703

SEQ ID NO: 52114 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000355705

SEQ ID NO: 52115 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000355707

SEQ ID NO: 52116 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000355708

SEQ ID NO: 52117 - protein, 128 aa, Homo sapiens; identical to SEQ ID NO: 52099
  Payload ID: 10377
  Gene Symbol: MRPL55
  Gene Name: mitochondrial ribosomal protein L55
  Uniprot ID: Q7Z7F7
  ENSP ID: ENSP00000375740

SEQ ID NO: 52118 - protein, 43 aa, Homo sapiens
  Payload ID: 10377
  Gene Symbol: MRPL55
  Gene Name: mitochondrial ribosomal protein L55
  ENSP ID: ENSP00000401737
MAAVGSLLGRLRQSTVKATGPALRRLHTSSWRADSSRASLTRV

SEQ ID NO: 52119 - protein, 164 aa, Homo sapiens; identical to SEQ ID NO: 52109
  Payload ID: 10377
  Gene Symbol: MRPL55
  Gene Name: mitochondrial ribosomal protein L55
  Uniprot ID: Q7Z7F7
  ENSP ID: ENSP00000403614

SEQ ID NO: 52120 - protein, 76 aa, Homo sapiens
  Payload ID: 10377
  Gene Symbol: MRPL55
  Gene Name: mitochondrial ribosomal protein L55
  ENSP ID: ENSP00000409966
MAAVGSLLGRLRQSTVKATGPALRRLHTSSWRADSSRASLTRVHRQAYARLYPVLLVKQDGSTIHIRYREPRRMLA

SEQ ID NO: 52121 - protein, 4 aa, Homo sapiens
  Payload ID: 10377
  Gene Symbol: MRPL55
  Gene Name: mitochondrial ribosomal protein L55
  ENSP ID: ENSP00000479251
MAAV

SEQ ID NO: 52122 - protein, 8 aa, Homo sapiens
  Payload ID: 10377
  Gene Symbol: MRPL55
  Gene Name: mitochondrial ribosomal protein L55
  ENSP ID: ENSP00000479463
MAAVGSLL

SEQ ID NO: 52123 - protein, 55 aa, Homo sapiens; identical to SEQ ID NO: 52103
  Payload ID: 10377
  Gene Symbol: MRPL55
  Gene Name: mitochondrial ribosomal protein L55
  ENSP ID: ENSP00000482290

SEQ ID NO: 52124 - protein, 24 aa, Homo sapiens
  Payload ID: 10377
  Gene Symbol: MRPL55
  Gene Name: mitochondrial ribosomal protein L55
  ENSP ID: ENSP00000484813
MAAVGSLLGRLRQSTVKATGPALR

SEQ ID NO: 52125 - protein, 102 aa, Homo sapiens
  Payload ID: 10378
  Gene Symbol: MRPL57
  Gene Name: mitochondrial ribosomal protein L57
  Uniprot ID: Q9BQC6
  ENSP ID: ENSP00000310726
MFLTALLWRGRIPGRQWIGKHRRPRFVSLRAKQNMIRRLEIEAENHYWLSMPYMTREQERGHAAVRRREAFEAIKAAATSKFPPHRFIADQLDHLNVTKKWS

SEQ ID NO: 52126 - protein, 233 aa, Homo sapiens
  Payload ID: 10379
  Gene Symbol: MRPL9
  Gene Name: mitochondrial ribosomal protein L9
  ENSP ID: ENSP00000357822
MAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVENVGVRGDLVSVKKSLGRNRLLPQGLAVYASPENKKLFEEEKLLRQEGKLEKIQTKAGEALGVVVAPHTLKLPEEPITRWGEYWCEVTVNGLDTVRVPMSVVNFEKPKTKRYKYWLAQQAAKAMAPTSPQI

SEQ ID NO: 52127 - protein, 267 aa, Homo sapiens [sequence omitted]

SEQ ID NO: 52128 - protein, 201 aa, Homo sapiens
  Payload ID: 10380
  Gene Symbol: MRPS10
  Gene Name: mitochondrial ribosomal protein S10
  Uniprot ID: P82664
  ENSP ID: ENSP00000053468
MAARTAFGAVCRRLWQGLGNFSVNTSKGNTAKNGGLLLSTNMKWVQFSNLHVDVPKDLTKPVVTISDEPDILYKRLSVLVKGHDKAVLDSYEYFAVLAAKELGISIKVHEPPRKIERFTLLQSVHIYKKHRVQYEMRTLYRCLELEHLTGSTADVYLEYIQRNLPEGVAMEVTKTQLEQLPEHIKEPIWETLSEEKEESKS

SEQ ID NO: 52129 - protein, 194 aa, Homo sapiens
  Payload ID: 10381
  Gene Symbol: MRPS11
  Gene Name: mitochondrial ribosomal protein S11
  Uniprot ID: P82912
  ENSP ID: ENSP00000317376
MQAVRNAGSRFLRSWTWPQTAGRVVARTPAGTICTGARQLQDAAAKQKVEQNAAPSHTKFSIYPPIPGEESSLRWAGKKFEEIPIAHIKASHNNTQIQVVSASNEPLAFASCGTEGFRNAKKGTGIAAQTAGIAAAARAKQKGVIHIRVVVKGLGPGRLSAMHGLIMGGLEVISITDNTPIPHNGCRPRKARKL

SEQ ID NO: 52130 - protein, 161 aa, Homo sapiens
  Payload ID: 10381
  Gene Symbol: MRPS11
  Gene Name: mitochondrial ribosomal protein S11
  Uniprot ID: P82912
  ENSP ID: ENSP00000318054
MQAVRNAGSRFLRSWTWPQTAGRVVARTPAGTICTGARQLQDAAAKQKVEQNAAPSHTKFSTQIQVVSASNEPLAFASCGTEGFRNAKKGTGIAAQTAGIAAAARAKQKGVIHIRVVVKGLGPGRLSAMHGLIMGGLEVISITDNTPIPHNGCRPRKARKL

SEQ ID NO: 52131 - protein, 118 aa, Homo sapiens
  Payload ID: 10381
  Gene Symbol: MRPS11
  Gene Name: mitochondrial ribosomal protein S11
  ENSP ID: ENSP00000453116
MQAVRNAGSRFLRSWTWPQTAGRVVARTPAGTICTGARQLQDAAAKQKVEQNAAPSHTKFSIYPPIPGEESSLRWAGKKFEEIPIAHIKASHNKGISECQEGHRHRSTDSRHSRSGES

SEQ ID NO: 52132 - protein, 138 aa, Homo sapiens
  Payload ID: 10382
  Gene Symbol: MRPS12
  Gene Name: mitochondrial ribosomal protein S12
  Uniprot ID: O15235
  ENSP ID: ENSP00000308845
MSWSGLLHGLNTSLTCGPALVPRLWATCSMATLNQMHRLGPPKRPPRKLGPTEGRPQLKGVVLCTFTRKPKKPNSANRKCCRVRLSTGREAVCFIPGEGHTLQEHQIVLVEGGRTQDLPGVKLTVVRGKYDCGHVQKK

SEQ ID NO: 52133 - protein, 138 aa, Homo sapiens; identical to SEQ ID NO: 52132
  Payload ID: 10382
  Gene Symbol: MRPS12
  Gene Name: mitochondrial ribosomal protein S12
  Uniprot ID: O15235
  ENSP ID: ENSP00000384579

SEQ ID NO: 52134 - protein, 138 aa, Homo sapiens; identical to SEQ ID NO: 52132
  Payload ID: 10382
  Gene Symbol: MRPS12
  Gene Name: mitochondrial ribosomal protein S12
  Uniprot ID: O15235
  ENSP ID: ENSP00000384952

SEQ ID NO: 52135 - protein, 138 aa, Homo sapiens; identical to SEQ ID NO: 52132
  Payload ID: 10382
  Gene Symbol: MRPS12
  Gene Name: Mitochondrial ribosomal protein S12
  ENSP ID: ENSP00000488926

SEQ ID NO: 52136 - protein, 138 aa, Homo sapiens; identical to SEQ ID NO: 52132
  Payload ID: 10382
  Gene Symbol: MRPS12
  Gene Name: Mitochondrial ribosomal protein S12
  ENSP ID: ENSP00000489374

SEQ ID NO: 52137 - protein, 138 aa, Homo sapiens; identical to SEQ ID NO: 52132
  Payload ID: 10382
  Gene Symbol: MRPS12
  Gene Name: Mitochondrial ribosomal protein S12
  ENSP ID: ENSP00000489467

SEQ ID NO: 52138 - protein, 128 aa, Homo sapiens
  Payload ID: 10383
  Gene Symbol: MRPS14
  Gene Name: mitochondrial ribosomal protein S14
  Uniprot ID: O60783
  ENSP ID: ENSP00000420714
MAAFMLGSLLRTFKQMVPSSASGQVRSHYVDWRMWRDVKRRKMAYEYADERLRINSLRKNTILPKILQDVADEEIAALPRDSCPVRIRNRCVMTSRPRGVKRRWRLSRIVFRHLADHGQLSGIQRATW

SEQ ID NO: 52139 - protein, 60 aa, Homo sapiens
  Payload ID: 10383
  Gene Symbol: MRPS14
  Gene Name: mitochondrial ribosomal protein S14
  ENSP ID: ENSP00000431220
MAAFMLGSLLRTFKQVRPLLLSTPLPLTAESHNPRVPHGSATCSARWFLHQLQAKFEVTM

SEQ ID NO: 52140 - protein, 257 aa, Homo sapiens
  Payload ID: 10384
  Gene Symbol: MRPS15
  Gene Name: mitochondrial ribosomal protein S15
  Uniprot ID: P82914
  ENSP ID: ENSP00000362208
MLRVAWRTLSLIRTRAVTQVLVPGLPGGGSAKFPFNQWGLQPRSLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKNLRNTNYDVFEKICWGLGIEYTFPPLYYRRAHRRFVTKKALCIRVFQETQKLKKRRRALKAAAAAQKQAKRRNPDSPAKAIPKTLKDSQ

SEQ ID NO: 52141 - protein, 99 aa, Homo sapiens
  Payload ID: 10385
  Gene Symbol: MRPS16
  Gene Name: mitochondrial ribosomal protein S16
  ENSP ID: ENSP00000362031
MVHLTTLLCKAYRGGHLTIRLALGGCTNRPFYRIVAAHNKCPRDGRFVEQLGSYDPLPNSHGEKLVALNLDRIRHWIGCGAHLSKPMEKLLGLKYSHVF

SEQ ID NO: 52142 - protein, 137 aa, Homo sapiens
  Payload ID: 10385
  Gene Symbol: MRPS16
  Gene Name: mitochondrial ribosomal protein S16
  Uniprot ID: Q9Y3D3
  ENSP ID: ENSP00000362036
MVHLTTLLCKAYRGGHLTIRLALGGCTNRPFYRIVAAHNKCPRDGRFVEQLGSYDPLPNSHGEKLVALNLDRIRHWIGCGAHLSKPMEKLLGLAGFFPLHPMMITNAERLRRKRAREVLLASQKTDAEATDTEATET

SEQ ID NO: 52143 - protein, 130 aa, Homo sapiens
  Payload ID: 10386
  Gene Symbol: MRPS17
  Gene Name: mitochondrial ribosomal protein S17
  Uniprot ID: Q9Y2R5
  ENSP ID: ENSP00000285298
MSVVRSSVHARWIVGKVIGTKMQKTAKVRVTRLVLDPYLLKYFNKRKTYFAHDALQQCTVGDIVLLRALPVPRAKHVKHELAEIVFKVGKVIDPVTGKPCAGTTYLESPLSSETTQLSKNLEELNISSAQ

SEQ ID NO: 52144 - protein, 129 aa, Homo sapiens
  Payload ID: 10386
  Gene Symbol: MRPS17
  Gene Name: mitochondrial ribosomal protein S17
  ENSP ID: ENSP00000401349
MSVVRSSVHARWIVGKVIGTKMQKTAKVRVTRLVLDPYLLKYFNKRKTYFAHDALQQCTVGDIVLLRALPVPRAKHVKHELAEIVFKVGKVIDPVTGKPCAGTTYLESPLSSETTQLSKNLEELNISSA

SEQ ID NO: 52145 - protein, 127 aa, Homo sapiens
  Payload ID: 10387
  Gene Symbol: MRPS18A
  Gene Name: mitochondrial ribosomal protein S18A
  Uniprot ID: Q9NVS2
  ENSP ID: ENSP00000361188
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGT

SEQ ID NO: 52146 - protein, 196 aa, Homo sapiens
  Payload ID: 10387
  Gene Symbol: MRPS18A
  Gene Name: mitochondrial ribosomal protein S18A
  Uniprot ID: Q9NVS2
  ENSP ID: ENSP00000361206
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGLLPNHRPRLPEGVVPKSKPQLNRYLTRWAPGSVKPIYKKGPRWNRVRMPVGSPLLRDNVCYSRTPWKLYH

SEQ ID NO: 52147 - protein, 263 aa, Homo sapiens
  Payload ID: 10387
  Gene Symbol: MRPS18A
  Gene Name: mitochondrial ribosomal protein S18A
  ENSP ID: ENSP00000398679
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGRRPWGPRGAEGCRHSLPTQLPHVSAPPGRKVDIRSVNYTHHPMPTFPLPWAFPLAPSELQRELQRLSPLPRHSGLLPNHRPRLPEGVVPKSKPQLNRYLTRWAPGSVKPIYKKGPRWNRVRMPVGSPLLRDNVCYSR

SEQ ID NO: 52148 - protein, 258 aa, Homo sapiens
  Payload ID: 10388
  Gene Symbol: MRPS18B
  Gene Name: mitochondrial ribosomal protein S18B
  Uniprot ID: Q9Y676
  ENSP ID: ENSP00000259873
MAASVLNTVLRRLPMLSLFRGSHRVQVPLQTLCTKAPSEEDSLSSVPISPYKDEPWKYLESEEYQERYGSRPVWADYRRNHKGGVPPQRTRKTCIRRNKVVGNPCPICRDHKLHVDFRNVKLLEQFVCAHTGIIFYAPYTGVCVKQHKRLTQAIQKARDHGLLIYHIPQVEPRDLDFSTSHGAVSATPPAPTLVSGDPWYPWYNWKQPPERELSRLRRLYQGHLQEESGPPPESMPKMPPRTPAEASSTGQTGPQSAL

SEQ ID NO: 52149 - protein, 215 aa, Homo sapiens
  Payload ID: 10388
  Gene Symbol: MRPS18B
  Gene Name: mitochondrial ribosomal protein S18B
  ENSP ID: ENSP00000383437
MAASVLNTVLRRLPMLSLFRGSHRVQVPLQTLCTKAPSEEDSLSSVPISPYKDEPWKYLESEEYQERYGSRPVWADYRRNHKGGVPPQRTRKTCINVKLLEQFVCAHTGIIFYAPYTGLLIYHIPQVEPRDLDFSTSHGAVSATPPAPTLVSGDPWYPWYNWKQPPERELSRLRRLYQGHLQEESGPPPESMPKMPPRTPAEASSTGQTGPQSAL

SEQ ID NO: 52150 - protein, 258 aa, Homo sapiens; identical to SEQ ID NO: 52148
  Payload ID: 10388
  Gene Symbol: MRPS18B
  Gene Name: mitochondrial ribosomal protein S18B
  Uniprot ID: Q9Y676
  ENSP ID: ENSP00000383438

SEQ ID NO: 52151 - protein, 215 aa, Homo sapiens; identical to SEQ ID NO: 52149
  Payload ID: 10388
  Gene Symbol: MRPS18B
  Gene Name: mitochondrial ribosomal protein S18B
  ENSP ID: ENSP00000390930

SEQ ID NO: 52152 - protein, 215 aa, Homo sapiens; identical to SEQ ID NO: 52149
  Payload ID: 10388
  Gene Symbol: MRPS18B
  Gene Name: mitochondrial ribosomal protein S18B
  ENSP ID: ENSP00000397340

SEQ ID NO: 52153 - protein, 215 aa, Homo sapiens; identical to SEQ ID NO: 52149
  Payload ID: 10388
  Gene Symbol: MRPS18B
  Gene Name: mitochondrial ribosomal protein S18B
  ENSP ID: ENSP00000397472

SEQ ID NO: 52154 - protein, 258 aa, Homo sapiens; identical to SEQ ID NO: 52148
  Payload ID: 10388
  Gene Symbol: MRPS18B
  Gene Name: mitochondrial ribosomal protein S18B
  Uniprot ID: Q9Y676
  ENSP ID: ENSP00000397790

SEQ ID NO: 52155 - protein, 258 aa, Homo sapiens; identical to SEQ ID NO: 52148
  Payload ID: 10388
  Gene Symbol: MRPS18B
  Gene Name: mitochondrial ribosomal protein S18B
  Uniprot ID: Q9Y676
  ENSP ID: ENSP00000398494

SEQ ID NO: 52156 - protein, 215 aa, Homo sapiens; identical to SEQ ID NO: 52149
  Payload ID: 10388
  Gene Symbol: MRPS18B
  Gene Name: mitochondrial ribosomal protein S18B
  ENSP ID: ENSP00000398549

SEQ ID NO: 52157 - protein, 215 aa, Homo sapiens; identical to SEQ ID NO: 52149
  Payload ID: 10388
  Gene Symbol: MRPS18B
  Gene Name: mitochondrial ribosomal protein S18B
  ENSP ID: ENSP00000398781

SEQ ID NO: 52158 - protein, 258 aa, Homo sapiens; identical to SEQ ID NO: 52148
  Payload ID: 10388
  Gene Symbol: MRPS18B
  Gene Name: mitochondrial ribosomal protein S18B
  Uniprot ID: Q9Y676
  ENSP ID: ENSP00000402718

SEQ ID NO: 52159 - protein, 258 aa, Homo sapiens; identical to SEQ ID NO: 52148
  Payload ID: 10388
  Gene Symbol: MRPS18B
  Gene Name: mitochondrial ribosomal protein S18B
  Uniprot ID: Q9Y676
  ENSP ID: ENSP00000414972

SEQ ID NO: 52160 - protein, 258 aa, Homo sapiens; identical to SEQ ID NO: 52148
  Payload ID: 10388
  Gene Symbol: MRPS18B
  Gene Name: mitochondrial ribosomal protein S18B
  Uniprot ID: Q9Y676
  ENSP ID: ENSP00000415703

SEQ ID NO: 52161 - protein, 142 aa, Homo sapiens
  Payload ID: 10389
  Gene Symbol: MRPS18C
  Gene Name: mitochondrial ribosomal protein S18C
  Uniprot ID: Q9Y3D5
  ENSP ID: ENSP00000295491
MAAVVAVCGGLGRKKLTHLVTAAVSLTHPGTHTVLWRRGCSQQVSSNEDLPISMENPYKEPLKKCILCGKHVDYKNVQLLSQFVSPFTGCIYGRHITGLCGKKQKEITKAIKRAQIMGFMPVTYKDPAYLKDPKVCNIRYRE

SEQ ID NO: 52162 - protein, 92 aa, Homo sapiens
  Payload ID: 10389
  Gene Symbol: MRPS18C
  Gene Name: mitochondrial ribosomal protein S18C
  ENSP ID: ENSP00000425268
VAVCGGLGRKKLTHLVTAAVSLTHPGTHTVLWRRGCSQQVSSNEDLPISMENPYKEPLKKCILCGKHVDYKNVQVFVGRNRKKSQKQLRELK

SEQ ID NO: 52163 - protein, 68 aa, Homo sapiens
  Payload ID: 10389
  Gene Symbol: MRPS18C
  Gene Name: mitochondrial ribosomal protein S18C
  ENSP ID: ENSP00000426930
MAAVVAVCGGLGRKKLTHLVTAAVSLTHPGTHTVLWRRGCSQQVSSNEDLVFVGRNRKKSQKQLRELK

SEQ ID NO: 52164 - protein, 113 aa, Homo sapiens
  Payload ID: 10389
  Gene Symbol: MRPS18C
  Gene Name: mitochondrial ribosomal protein S18C
  ENSP ID: ENSP00000427014
  MOD_RES (1)..(1): Any amino acid
XAVVAVCGGLGRKKLTHLVTAAVSLTHPGTHTVLWRRGCSQQVSSNEDLLLSQFVSPFTGCIYGRHITGLCGKKQKEITKAIKRAQIMGFMPVTYKDPAYLKDPKVCNIRYRE

SEQ ID NO: 52165 - protein, 114 aa, Homo sapiens
  Payload ID: 10389
  Gene Symbol: MRPS18C
  Gene Name: mitochondrial ribosomal protein S18C
  ENSP ID: ENSP00000427169
MAAVVAVCGGLGRKKLTHLVTAAVSLTHPGTHTVLWRRGCSQQVSSNEDLLLSQFVSPFTGCIYGRHITGLCGKKQKEITKAIKRAQIMGFMPVTYKDPAYLKDPKVCNIRYRE

SEQ ID NO: 52166 - protein, 296 aa, Homo sapiens
  Payload ID: 10390
  Gene Symbol: MRPS2
  Gene Name: mitochondrial ribosomal protein S2
  Uniprot ID: Q9Y399
  ENSP ID: ENSP00000241600
MATSSAALPRILGAGARAPSRWLGFLGKATPRPARPSRRTLGSATALMIRESEDSTDFNDKILNEPLKHSDFFNVKELFSVRSLFDARVHLGHKAGCRHRFMEPYIFGSRLDHDIIDLEQTATHLQLALNFTAHMAYRKGIILFISRNRQFSYLIENMARDCGEYAHTRYFRGGMLTNARLLFGPTVRLPDLIIFLHTLNNIFEPHVAVRDAAKMNIPTVGIVDTNCNPCLITYPVPGNDDSPLAVHLYCRLFQTAITRAKEKRQQVEALYRLQGQKEPGDQGPAHPPGADMSHSL

SEQ ID NO: 52167 - protein, 296 aa, Homo sapiens; identical to SEQ ID NO: 52166
  Payload ID: 10390
  Gene Symbol: MRPS2
  Gene Name: mitochondrial ribosomal protein S2
  Uniprot ID: Q9Y399
  ENSP ID: ENSP00000360850

SEQ ID NO: 52168 - protein, 270 aa, Homo sapiens
  Payload ID: 10390
  Gene Symbol: MRPS2
  Gene Name: mitochondrial ribosomal protein S2
  ENSP ID: ENSP00000400082
RRGPLGMRWGAGVVHSGLGARTSIYFPPGARAPSRWLGFLGKATPRPARPSRRTLGSATALMIRESEDSTDFNDKILNEPLKHSDFFNVKELFSVRSLFDARVHLGHKAGCRHRFMEPYIFGSRLDHDIIDLEQTATHLQLALNFTAHMAYRKGIILFISRNRQFSYLIENMARDCGEYAHTRYFRGGMLTNARLLFGPTVRLPDLIIFLHTLNNIFEPHVAVRDAAKMNIPTVGIVDTNCNPCLITYPVPGNDDSPLAVHLYCRLFQTA

SEQ ID NO: 52169 - protein, 87 aa, Homo sapiens
  Payload ID: 10391
  Gene Symbol: MRPS21
  Gene Name: mitochondrial ribosomal protein S21
  ENSP ID: ENSP00000461930
MAKHLKFIARTVMVQEGNVESAYRTLNRILTMDGLIEDIKHRRYYEKPCCRRQRESYERCRRIYNMEMARKINFLMRKNRADPWQGC

SEQ ID NO: 52170 - protein, 87 aa, Homo sapiens; identical to SEQ ID NO: 52169
  Payload ID: 10391
  Gene Symbol: MRPS21
  Gene Name: mitochondrial ribosomal protein S21
  ENSP ID: ENSP00000480129

SEQ ID NO: 52171 - protein, 360 aa, Homo sapiens
  Payload ID: 10392
  Gene Symbol: MRPS22
  Gene Name: mitochondrial ribosomal protein S22
  Uniprot ID: P82650
  ENSP ID: ENSP00000310785
MAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 52172 - protein, 51 aa, Homo sapiens
  Payload ID: 10392
  Gene Symbol: MRPS22
  Gene Name: mitochondrial ribosomal protein S22
  ENSP ID: ENSP00000417104
MVQTGRSEGIPGWEQSMSKGREIPGSDSESGSPETKKPTFMDEEVQSILTK

SEQ ID NO: 52173 - protein, 360 aa, Homo sapiens; identical to SEQ ID NO: 52171
  Payload ID: 10392
  Gene Symbol: MRPS22
  Gene Name: mitochondrial ribosomal protein S22
  Uniprot ID: P82650
  ENSP ID: ENSP00000418008

SEQ ID NO: 52174 - protein, 359 aa, Homo sapiens
  Payload ID: 10392
  Gene Symbol: MRPS22
  Gene Name: mitochondrial ribosomal protein S22
  ENSP ID: ENSP00000418233
MAPLGTTVLLWSLLRSSPGVERVCFRARIQPWHGGLLQPLPCSFEMGLPRRRFSSEAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 52175 - protein, 319 aa, Homo sapiens
  Payload ID: 10392
  Gene Symbol: MRPS22
  Gene Name: mitochondrial ribosomal protein S22
  ENSP ID: ENSP00000419303
MSRNETEHRYLGTHFGAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 52176 - protein, 165 aa, Homo sapiens
  Payload ID: 10392
  Gene Symbol: MRPS22
  Gene Name: mitochondrial ribosomal protein S22
  ENSP ID: ENSP00000419737
  MOD_RES (1)..(1): Any amino acid
XTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRC

SEQ ID NO: 52177 - protein, 200 aa, Homo sapiens
  Payload ID: 10392
  Gene Symbol: MRPS22
  Gene Name: mitochondrial ribosomal protein S22
  ENSP ID: ENSP00000419920
GTTVLLWSLLRSSPGVERVCFRARIQPWHGGLLQPLPCSFEMGLPRRRFSSEAASYLLKSILAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQV

SEQ ID NO: 52178 - protein, 121 aa, Homo sapiens
  Payload ID: 10392
  Gene Symbol: MRPS22
  Gene Name: mitochondrial ribosomal protein S22
  ENSP ID: ENSP00000420229
  MOD_RES (1)..(1): Any amino acid
XKYVFTDISYSIPHRERFIVVREPSGTLRKASWEERDRMIQVYFPKEGRKILTPIIFKEENLRFEPDSTEYIKVHHKTYEDIDKRGKYDLLRSTRYFGGMVWYFVNNKKIDGLLIDQIQRD

SEQ ID NO: 52179 - protein, 168 aa, Homo sapiens
  Payload ID: 10392
  Gene Symbol: MRPS22
  Gene Name: mitochondrial ribosomal protein S22
  Uniprot ID: P82650
  ENSP ID: ENSP00000420482
MAPLGTTVLLWSLLRSSPGVERVCFRARIQPWHGGLLQPLPCSFEMGLPRRRFSSEAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRC

SEQ ID NO: 52180 - protein, 190 aa, Homo sapiens
  Payload ID: 10393
  Gene Symbol: MRPS23
  Gene Name: mitochondrial ribosomal protein S23
  Uniprot ID: Q9Y3D9
  ENSP ID: ENSP00000320184
MAGSRLETVGSIFSRTRDLVRAGVLKEKPLWFDVYDAFPPLREPVFQRPRVRYGKAKAPIQDIWYHEDRIRAKFYSVYGSGQRAFDLFNPNFKSTCQRFVEKYTELQKLGETDEEKLFVETGKALLAEGVILRRVGEARTQHGGSHVSRKSEHLSVRPQTALEENETQKEVPQDQHLEAPADQSKGLLPP

SEQ ID NO: 52181 - protein, 61 aa, Homo sapiens
  Payload ID: 10393
  Gene Symbol: MRPS23
  Gene Name: mitochondrial ribosomal protein S23
  ENSP ID: ENSP00000463481
MAKPKLPSKTSGTTRIGLERSFIQCMGLVKELLIYSIQTSSLPVNGLWRSTLSYRNLEKQM

SEQ ID NO: 52182 - protein, 152 aa, Homo sapiens
  Payload ID: 10393
  Gene Symbol: MRPS23
  Gene Name: mitochondrial ribosomal protein S23
  ENSP ID: ENSP00000463677
MAGSRLETVGSIFSRTRDLVRAGVLKEKPLWFDVYDAFPPLREPVFQRPRVRYGKAKAPIQDIWYHEDRIRAKFYSVYGSGQRAFDLFNPNFKSTCQRFVEKYTELQKLGETDEEKLFVETGKALLAEGVILRRVGEARTVSISLLKLLLGL

SEQ ID NO: 52183 - protein, 167 aa, Homo sapiens
  Payload ID: 10394
  Gene Symbol: MRPS24
  Gene Name: mitochondrial ribosomal protein S24
  Uniprot ID: Q96EL2
  ENSP ID: ENSP00000318158
MAASVCSGLLGPRVLSWSRELPCAWRALHTSPVCAKNRAARVRVSKGDKPVTYEEAHAPHYIAHRKGWLSLHTGNLDGEDHAAERTVEDVFLRKFMWGTFPGCLADQLVLKRRGNQLEICAVVLRQLSPHKYYFLVGYSETLLSYFYKCPVRLHLQTVPSKVVYKYL

SEQ ID NO: 52184 - protein, 72 aa, Homo sapiens
  Payload ID: 10394
  Gene Symbol: MRPS24
  Gene Name: mitochondrial ribosomal protein S24
  ENSP ID: ENSP00000407625
MWGTFPGCLADQLVLKRRGNQLEICAVVLRQLSPHKYYFLVGYSETLLSYFYKCPVRLHLQTVPSKVVYKYL

SEQ ID NO: 52185 - protein, 173 aa, Homo sapiens
  Payload ID: 10395
  Gene Symbol: MRPS25
  Gene Name: mitochondrial ribosomal protein S25
  Uniprot ID: P82663
  ENSP ID: ENSP00000253686
MPMKGRFPIRRTLQYLSQGNVVFKDSVKVMTVNYNTHGELGEGARKFVFFNIPQIQYKNPWVQIMMFKNMTPSPFLRFYLDSGEQVLVDVETKSNKEIMEHIRKILGKNEETLREEEEEKKQLSHPANFGPRKYCLRECICEVEGQVPCPSLVPLPKEMRGKYKAALKADAQD

SEQ ID NO: 52186 - protein, 145 aa, Homo sapiens
  Payload ID: 10395
  Gene Symbol: MRPS25
  Gene Name: mitochondrial ribosomal protein S25
  Uniprot ID: P82663
  ENSP ID: ENSP00000390882
MPMKGRFPIRRTLQYLSQGNVVFKDSVKVMTVNYNTHGELGEGARKFVFFNIPQIQYKNPWVQIMMFKNMTPSPFLRFYLDSGEQVLVDVETKSNKEIMEHIRKILGKNEHYLAAPSKPVSSAVVPVTQEAEAGGSLEPRRLRLE

SEQ ID NO: 52187 - protein, 110 aa, Homo sapiens
  Payload ID: 10395
  Gene Symbol: MRPS25
  Gene Name: mitochondrial ribosomal protein S25
  ENSP ID: ENSP00000396828
MPMKGRFPIRRTLQYLSQGNVVFKDSVKVMTVNYNTHGELGEGARKFVFFNIPQIQYKNPWVQIMMFKNMTPSPFLRFYLDSGEQVLVDVETKSNKEIMEHIRKILGKNE

SEQ ID NO: 52188 - protein, 110 aa, Homo sapiens; identical to SEQ ID NO: 52187
  Payload ID: 10395
  Gene Symbol: MRPS25
  Gene Name: mitochondrial ribosomal protein S25
  ENSP ID: ENSP00000402068

SEQ ID NO: 52189 - protein, 129 aa, Homo sapiens
  Payload ID: 10395
  Gene Symbol: MRPS25
  Gene Name: mitochondrial ribosomal protein S25
  Uniprot ID: P82663
  ENSP ID: ENSP00000407733
MPMKGRFPIRRTLQYLSQGNVVFKDSVKVMTVNYNTHGELGEGARKFVFFNIPQIQYKNPWVQIMMFKNMTPSPFLRFYLGKPSGKRRRRKSSFLTQPTSALESTACGSASVKWKGRCPAPAWCHYPRR

SEQ ID NO: 52190 - protein, 205 aa, Homo sapiens
  Payload ID: 10396
  Gene Symbol: MRPS26
  Gene Name: mitochondrial ribosomal protein S26
  Uniprot ID: Q9BYN8
  ENSP ID: ENSP00000369682
MLRALSRLGAGTPCRPRAPLVLPARGRKTRHDPLAKSKIERVNMPPAVDPAEFFVLMERYQHYRQTVRALRMEFVSEVQRKVHEARAGVLAERKALKDAAEHRELMAWNQAENRRLHELRIARLRQEEREQEQRQALEQARKAEEVQAWAQRKEREVLQLQEEVKNFITRENLEARVEAALDSRKNYNWAITREGLVVRPQRRDS

SEQ ID NO: 52191 - protein, 414 aa, Homo sapiens
  Payload ID: 10397
  Gene Symbol: MRPS27
  Gene Name: mitochondrial ribosomal protein S27
  Uniprot ID: Q92552
  ENSP ID: ENSP00000261413
MAASIVRRGMLLARQVVLPQLSPAGKRYLLSSAYVDSHKWEAREKEHYCLADLASLMDKTFERKLPVSSLTISRLIDNISSREEIDHAEYYLYKFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKVELQQGLRAVYHNMPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 52192 - protein, 299 aa, Homo sapiens
  Payload ID: 10397
  Gene Symbol: MRPS27
  Gene Name: mitochondrial ribosomal protein S27
  ENSP ID: ENSP00000426176
MDKTFERKLPVSSLTISRLIDNISSREEIDHAEYYLYKFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKVELQQGLRAVYHNMPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSL

SEQ ID NO: 52193 - protein, 428 aa, Homo sapiens
  Payload ID: 10397
  Gene Symbol: MRPS27
  Gene Name: mitochondrial ribosomal protein S27
  Uniprot ID: Q92552
  ENSP ID: ENSP00000426941
MAASIVRRGMLLARQVVLPQLSPAGKRYLLSSAYVDSHKWEAREKEHYCLADLASLMDKTFERKLPVSSLTISRLIDNISSREEIDHAEYYLYKKGECSSSNPQNYSRFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKVELQQGLRAVYHNMPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 52194 - protein, 197 aa, Homo sapiens
  Payload ID: 10397
  Gene Symbol: MRPS27
  Gene Name: mitochondrial ribosomal protein S27
  ENSP ID: ENSP00000427237
MDKTFERKLPVSSLTISRLIDNISSREEIDHAEYYLYKFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKLNDPYKYCSSWLELLHSSSS

SEQ ID NO: 52195 - protein, 358 aa, Homo sapiens
  Payload ID: 10397
  Gene Symbol: MRPS27
  Gene Name: mitochondrial ribosomal protein S27
  ENSP ID: ENSP00000428120
MDKTFERKLPVSSLTISRLIDNISSREEIDHAEYYLYKFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKVELQQGLRAVYHNMPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 52196 - protein, 94 aa, Homo sapiens
  Payload ID: 10397
  Gene Symbol: MRPS27
  Gene Name: mitochondrial ribosomal protein S27
  ENSP ID: ENSP00000430590
MAASIVRRGMLLARQVVLPQLSPAGKRYLLSSAYVDSHKWEAREKEHYCLADLASLMDKTFERKLPVSSLTISRLIDNISSREEIDHAEYYLYK

SEQ ID NO: 52197 - protein, 187 aa, Homo sapiens
  Payload ID: 10398
  Gene Symbol: MRPS28
  Gene Name: mitochondrial ribosomal protein S28
  Uniprot ID: Q9Y2Q9
  ENSP ID: ENSP00000276585
MAALCRTRAVAAESHFLRVFLFFRPFRGVGTESGSESGSSNAKEPKTRAGGFASALERHSELLQKVEPLQKGSPKNVESFASMLRHSPLTQMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 52198 - protein, 162 aa, Homo sapiens
  Payload ID: 10398
  Gene Symbol: MRPS28
  Gene Name: mitochondrial ribosomal protein S28
  ENSP ID: ENSP00000427846
  MOD_RES (1)..(1): Any amino acid
XTRAVAAESHFLRVFLFFRPFRGVGTESGSESGSSNAKEPKTRAGGFASALERHSELLQKRWGFAMLPRLVLNSWVQVILLRWPPKVLGLQMTDGSPKNVESFASMLRHSPLTQMGPAKDKLVIGRIFHIVENDLYIDFGGKFHCVCRRPEVDGEKYQKGTR

SEQ ID NO: 52199 - protein, 86 aa, Homo sapiens
  Payload ID: 10398
  Gene Symbol: MRPS28
  Gene Name: mitochondrial ribosomal protein S28
  ENSP ID: ENSP00000427965
MAALCRTRAVAAESHFLRVFLFFRPFRGVGTESGSESGSSNAKEPKTRAGGFASALERHSELLQKVEPLQKEIPERNQGPVAAIRS

SEQ ID NO: 52200 - protein, 143 aa, Homo sapiens
  Payload ID: 10398
  Gene Symbol: MRPS28
  Gene Name: mitochondrial ribosomal protein S28
  ENSP ID: ENSP00000428050
  MOD_RES (1)..(1): Any amino acid
XFCVAFAYWAGSVHTALVFLGLNAGGKGSPKNVESFASMLRHSPLTQMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 52201 - protein, 103 aa, Homo sapiens
  Payload ID: 10398
  Gene Symbol: MRPS28
  Gene Name: mitochondrial ribosomal protein S28
  ENSP ID: ENSP00000428744
MLRHSPLTQMGPAKDKLVIGRIFHIVENDLYIDFGGKFHCVCRRPEVDGEKYQKGTRVRLRLLDLELTSRFLGATTDTTVLEANAVLLGIQESKDSRSKEEHH

SEQ ID NO: 52202 - protein, 125 aa, Homo sapiens
  Payload ID: 10398
  Gene Symbol: MRPS28
  Gene Name: mitochondrial ribosomal protein S28
  ENSP ID: ENSP00000428880
MLPRLVLNSWVQVILLRWPPKVLGLQMTDMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 52203 - protein, 108 aa, Homo sapiens
  Payload ID: 10398
  Gene Symbol: MRPS28
  Gene Name: mitochondrial ribosomal protein S28
  ENSP ID: ENSP00000430401
MLPRLVLNSWVQVILLRWPPKVLGLQMTDMGPAKDKLVIGRIFHIVENDLYIDFGGKFHCVCRRPEVDGEKYQKGTRVRLRLLDLELTSRFLGATTDTTVLEANAVLL

SEQ ID NO: 52204 - protein, 83 aa, Homo sapiens
  Payload ID: 10398
  Gene Symbol: MRPS28
  Gene Name: mitochondrial ribosomal protein S28
  ENSP ID: ENSP00000476135
  MOD_RES (1)..(1): Any amino acid
XMLRHSPLTQMGPAKDKLVIGRIFHIVENDLYIDFGGKFHCVCRRPEVDGESPISWYAVWRRFSQVMITCFSSNSDFGKHRKR

SEQ ID NO: 52205 - protein, 439 aa, Homo sapiens
  Payload ID: 10399
  Gene Symbol: MRPS30
  Gene Name: mitochondrial ribosomal protein S30
  Uniprot ID: Q9NP92
  ENSP ID: ENSP00000424328
MAAARCWRPLLRGPRLSLHTAANAAATATETTCQDVAATPVARYPPIVASMTADSKAARLRRIERWQATVHAAESVDEKLRILTKMQFMKYMVYPQTFALNADRWYQYFTKTVFLSGLPPPPAEPEPEPEPEPEPALDLAALRAVACDCLLQEHFYLRRRRRVHRYEESEVISLPFLDQLVSTLVGLLSPHNPALAAAALDYRCPVHFYWVRGEEIIPRGHRRGRIDDLRYQIDDKPNNQIRISKQLAEFVPLDYSVPIEIPTIKCKPDKLPLFKRQYENHIFVGSKTADPCCYGHTQFHLLPDKLRRERLLRQNCADQIEVVFRANAIASLFAWTGAQAMYQGFWSEADVTRPFVSQAVITDGKYFSFFCYQLNTLALTTQADQNNPRKNICWGTQSKPLYETIEDNDVKGFNDDVLLQIVHFLLNRPKEEKSQLLEN

SEQ ID NO: 52206 - protein, 337 aa, Homo sapiens
  Payload ID: 10399
  Gene Symbol: MRPS30
  Gene Name: mitochondrial ribosomal protein S30
  ENSP ID: ENSP00000479189
MPTAGTSTSPRPCSCRVCRRPQRSPSPSPNPNLNLRWTSRRCVRSPATACCRSTYLRRGGACTVTRRARSYLCPSWISWCQPSWASSAHTTRPWPAALDYRCPVHFYWVRGEEIIPRGHRRGRIDDLRYQIDDKPNNQIRISKQLAEFVPLDYSVPIEIPTIKCKPDKLPLFKRQYENHIFVGSKTADPCCYGHTQFHLLPDKLRRERLLRQNCADQIEVVFRANAIASLFAWTGAQAMYQGFWSEADVTRPFVSQAVITDGKYFSFFCYQLNTLALTTQADQNNPRKNICWGTQSKPLYETIEDNDVKGFNDDVLLQIVHFLLNRPKEEKSQLLEN

SEQ ID NO: 52207 - protein, 395 aa, Homo sapiens
  Payload ID: 10400
  Gene Symbol: MRPS31
  Gene Name: mitochondrial ribosomal protein S31
  Uniprot ID: Q92665
  ENSP ID: ENSP00000315397
MFPRVSTFLPLRPLSRHPLSSGSPETSAAAIMLLTVRHGTVRYRSSALLARTKNNIQRYFGTNSVICSKKDKQSVRTEETSKETSESQDSEKENTKKDLLGIIKGMKVELSTVNVRTTKPPKRRPLKSLEATLGRLRRATEYAPKKRIEPLSPELVAAASAVADSLPFDKQTTKSELLSQLQQHEEESRAQRDAKRPKISFSNIISDMKVARSATARVRSRPELRIQFDEGYDNYPGQEKTDDLKKRKNIFTGKRLNIFDMMAVTKEAPETDTSPSLWDVEFAKQLATVNEQPLQNGFEELIQWTKEGKLWEFPINNEAGFDDDGSEFHEHIFLEKHLESFPKQGPIRHFMELVTCGLSKNPYLSVKQKVEHIEWFRNYFNEKKDILKESNIQFN

SEQ ID NO: 52208 - protein, 106 aa, Homo sapiens
  Payload ID: 10401
  Gene Symbol: MRPS33
  Gene Name: mitochondrial ribosomal protein S33
  Uniprot ID: Q9Y291
  ENSP ID: ENSP00000320567
MSSLSEYAFRMSRLSARLFGEVTRPTNSKSMKVVKLFSELPLAKKKETYDWYPNHHTYAELMQTLRFLGLYRDEHQDFMDEQKRLKKLRGKEKPKKGEGKRAAKRK

SEQ ID NO: 52209 - protein, 106 aa, Homo sapiens; identical to SEQ ID NO: 52208
  Payload ID: 10401
  Gene Symbol: MRPS33
  Gene Name: mitochondrial ribosomal protein S33
  Uniprot ID: Q9Y291
  ENSP ID: ENSP00000376732

SEQ ID NO: 52210 - protein, 106 aa, Homo sapiens; identical to SEQ ID NO: 52208
  Payload ID: 10401
  Gene Symbol: MRPS33
  Gene Name: mitochondrial ribosomal protein S33
  Uniprot ID: Q9Y291
  ENSP ID: ENSP00000417287

SEQ ID NO: 52211 - protein, 106 aa, Homo sapiens; identical to SEQ ID NO: 52208
  Payload ID: 10401
  Gene Symbol: MRPS33
  Gene Name: mitochondrial ribosomal protein S33
  Uniprot ID: Q9Y291
  ENSP ID: ENSP00000418451

SEQ ID NO: 52212 - protein, 96 aa, Homo sapiens
  Payload ID: 10401
  Gene Symbol: MRPS33
  Gene Name: mitochondrial ribosomal protein S33
  ENSP ID: ENSP00000420709
MSRLSARLFGEVTRPTNSKSMKVVKLFSELPLAKKKETYDWYPNHHTYAELMQTLRFLGLYRDEHQDFMDEQKRLKKLRGKEKPKKGEGKRAAKRK

SEQ ID NO: 52213 - protein, 225 aa, Homo sapiens
  Payload ID: 10402
  Gene Symbol: MRPS34
  Gene Name: mitochondrial ribosomal protein S34
  ENSP ID: ENSP00000177742
MARKKVRPRLIAELARRVRALREQLNRPRDSQLYAVDYETLTRPFSGRRLPVRAWADVRRESRLLQLLGRLPLFGLGRLVTRKSWLWQHDEPCYWRLTRVRPDYTAQNLDHGKAWGILTFKDASFSSSGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPV

SEQ ID NO: 52214 - protein, 218 aa, Homo sapiens
  Payload ID: 10402
  Gene Symbol: MRPS34
  Gene Name: mitochondrial ribosomal protein S34
  Uniprot ID: P82930
  ENSP ID: ENSP00000380531
MARKKVRPRLIAELARRVRALREQLNRPRDSQLYAVDYETLTRPFSGRRLPVRAWADVRRESRLLQLLGRLPLFGLGRLVTRKSWLWQHDEPCYWRLTRVRPDYTAQNLDHGKAWGILTFKGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPV

SEQ ID NO: 52215 - protein, 176 aa, Homo sapiens
  Payload ID: 10402
  Gene Symbol: MRPS34
  Gene Name: mitochondrial ribosomal protein S34
  ENSP ID: ENSP00000479049
MARKKVRPRLIAELARRVRALREQLNRPRDSQLYAVDYETLTRPFSGRRLPVRAWADVRRESRLLQLLGRLPLFGLGRLVTRKSWLWQHDEPCYWRLTRVRPDYTAQNLDHGKAWGILTFKDASFSSSGKTESEAREIEHVMYHDWRLVPKHEEEAFTASRRAGRQLASCRPASGP

SEQ ID NO: 52216 - protein, 323 aa, Homo sapiens
  Payload ID: 10403
  Gene Symbol: MRPS35
  Gene Name: mitochondrial ribosomal protein S35
  Uniprot ID: P82673
  ENSP ID: ENSP00000081029
MAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRVKLSSLNLDDHAKKKLIKLVGERYCKTTDVLTIKTDRCPLRRQNYDYAVYLLTVLYHESWNTEEWEKSKTEADMEEYIWENSSSERNILETLLQMKAAEKNMEINKEELLGTKEIEEYKKSVVSLKNEEENENSISQYKESVKRLLNVT

SEQ ID NO: 52217 - protein, 41 aa, Homo sapiens
  Payload ID: 10403
  Gene Symbol: MRPS35
  Gene Name: mitochondrial ribosomal protein S35
  ENSP ID: ENSP00000437990
MAAAALPAWLSLQSRARTLRAFSTAVYSATPVPTPSLRTTS

SEQ ID NO: 52218 - protein, 38 aa, Homo sapiens
  Payload ID: 10403
  Gene Symbol: MRPS35
  Gene Name: mitochondrial ribosomal protein S35
  ENSP ID: ENSP00000437991
AAAALPAWLSLQSRARTLRAFSTAVYSATPVPTPSLQY

SEQ ID NO: 52219 - protein, 162 aa, Homo sapiens
  Payload ID: 10403
  Gene Symbol: MRPS35
  Gene Name: mitochondrial ribosomal protein S35
  ENSP ID: ENSP00000442137
  MOD_RES (1)..(1): Any amino acid
XARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLREM

SEQ ID NO: 52220 - protein, 194 aa, Homo sapiens
  Payload ID: 10403
  Gene Symbol: MRPS35
  Gene Name: mitochondrial ribosomal protein S35
  Uniprot ID: P82673
  ENSP ID: ENSP00000445390
MAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRVPFKEAELRLCSVSTNSVIP

SEQ ID NO: 52221 - protein, 103 aa, Homo sapiens
  Payload ID: 10404
  Gene Symbol: MRPS36
  Gene Name: mitochondrial ribosomal protein S36
  Uniprot ID: P82909
  ENSP ID: ENSP00000256441
MMGSKMASASRVVQVVKPHTPLIRFPDRRDNPKPNVSEALRSAGLPSHSSVISQHSKGSKSPDLLMYQGPPDTAEIIKTLPQKYRRKLVSQEEMEFIQRGGPE

SEQ ID NO: 52222 - protein, 38 aa, Homo sapiens
  Payload ID: 10404
  Gene Symbol: MRPS36
  Gene Name: mitochondrial ribosomal protein S36
  ENSP ID: ENSP00000423659
MYQGPPDTAEIIKTLPQKYRRKLVSQEEMEFIQRGGPE

SEQ ID NO: 52223 - protein, 38 aa, Homo sapiens; identical to SEQ ID NO: 52222
  Payload ID: 10404
  Gene Symbol: MRPS36
  Gene Name: mitochondrial ribosomal protein S36
  ENSP ID: ENSP00000473310

SEQ ID NO: 52224 - protein, 103 aa, Homo sapiens; identical to SEQ ID NO: 52221
  Payload ID: 10404
  Gene Symbol: MRPS36
  Gene Name: mitochondrial ribosomal protein S36
  Uniprot ID: P82909
  ENSP ID: ENSP00000482331

SEQ ID NO: 52225 - protein, 38 aa, Homo sapiens; identical to SEQ ID NO: 52222
  Payload ID: 10404
  Gene Symbol: MRPS36
  Gene Name: mitochondrial ribosomal protein S36
  ENSP ID: ENSP00000484623

SEQ ID NO: 52226 - protein, 430 aa, Homo sapiens
  Payload ID: 10405
  Gene Symbol: MRPS5
  Gene Name: mitochondrial ribosomal protein S5
  Uniprot ID: P82675
  ENSP ID: ENSP00000272418
MATAVRAVGCLPVLCSGTAGHLLGRQCSLNTLPAASILAWKSVLGNGHLSSLGTRDTHPYASLSRALQTQCCISSPSHLMSQQYRPYSFFTKLTADELWKGALAETGAGAKKGRGKRTKKKKRKDLNRGQIIGEGRYGFLWPGLNVPLMKNGAVQTIAQRSKEEQEKVEADMIQQREEWDRKKKMKVKRERGWSGNSWGGISLGPPDPGPCGETYEDFDTRILEVRNVFTMTAKEGRKKSIRVLVAVGNGKGAAGFSIGKATDRMDAFRKAKNRAVHHLHYIERYEDHTIFHDISLRFKRTHIKMKKQPKGYGLRCHRAIITICRLIGIKDMYAKVSGSINMLSLTQGLFRGLSRQETHQQLADKKGLHVVEIREECGPLPIVVASPRGPLRKDPEPEDEVPDVKLDWEDVKTAQGMKRSVWSNLKRAAT

SEQ ID NO: 52227 - protein, 251 aa, Homo sapiens
  Payload ID: 10405
  Gene Symbol: MRPS5
  Gene Name: mitochondrial ribosomal protein S5
  Uniprot ID: P82675
  ENSP ID: ENSP00000341660
MATAVRAVGCLPVLCSGTAGHLLGRQCSLNTLPAASILAWKSVLGNGHLSSLGTRDTHPYASLSRALQTQCCISSPSHLMSQQYRPYSFFTKLTADELWKGALAETGAGAKKGRGKRTKKKKRKDLNRGQIIGEGRYGFLWPGLNVPLMKNGAVQTIAQRSKEEQEKVEADMIQQREEWDRKKKMKVKRERGWSGNSWGGISLGPPDPGPCGETYEDFDTRILEVFLLGKLLIGWMLSGKQRTEQFTICII

SEQ ID NO: 52228 - protein, 125 aa, Homo sapiens
  Payload ID: 10406
  Gene Symbol: MRPS6
  Gene Name: mitochondrial ribosomal protein S6
  Uniprot ID: P82932
  ENSP ID: ENSP00000382250
MPRYELALILKAMQRPETAATLKRTIEALMDRGAIVRDLENLGERALPYRISAHSQQHNRGGYFLVDFYAPTAAVESMVEHLSRDIDVIRGNIVKHPLTQELKECEGIVPVPLAEKLYSTKKRKK

SEQ ID NO: 52229 - protein, 242 aa, Homo sapiens
  Payload ID: 10407
  Gene Symbol: MRPS7
  Gene Name: mitochondrial ribosomal protein S7
  Uniprot ID: Q9Y2R9
  ENSP ID: ENSP00000245539
MAAPAVKVARGWSGLALGVRRAVLQLPGLTQVRWSRYSPEFKDPLIDKEYYRKPVEELTEEEKYVRELKKTQLIKAAPAGKTSSVFEDPVISKFTNMMMIGGNKVLARSLMIQTLEAVKRKQFEKYHAASAEEQATIERNPYTIFHQALKNCEPMIGLVPILKGGRFYQVPVPLPDRRRRFLAMKWMITECRDKKHQRTLMPEKLSHKLLEAFHNQGPVIKRKHDLHKMAEANRALAHYRWW

SEQ ID NO: 52230 - protein, 156 aa, Homo sapiens
  Payload ID: 10407
  Gene Symbol: MRPS7
  Gene Name: mitochondrial ribosomal protein S7
  ENSP ID: ENSP00000462506
  MOD_RES (1)..(1): Any amino acid
XDPVISKFTNMMMIGGNKVLARSLMIQTLEAVKRKQFEKYHAASAEEQATIERNPYTIFHQALKNCEPMIGLVPILKGGRFYQVPVPLPDRRRRFLAMKWMITECRDKKHQRTLMPEKLSHKLLEAFHNQGPVIKRKHDLHKMAEANRALAHYRWW

SEQ ID NO: 52231 - protein, 28 aa, Homo sapiens
  Payload ID: 10407
  Gene Symbol: MRPS7
  Gene Name: mitochondrial ribosomal protein S7
  ENSP ID: ENSP00000462677
RAVLQLPGFCLPPPFPPSQANSGEMEPL

SEQ ID NO: 52232 - protein, 183 aa, Homo sapiens
  Payload ID: 10407
  Gene Symbol: MRPS7
  Gene Name: mitochondrial ribosomal protein S7
  ENSP ID: ENSP00000463263
MAAPAVKVARGWSGLALGVRRAVLQLPGLTQVRWSRYSPEFKDPLIDKEYYRKPVEELTEEEKYVRELKKTQLIKAAPAGKTSSVFEDPVISKFTNMMMIGGNKVLARSLMIQTLEAVKRKQFEKYHAASAEEQATIERNPYTIFHQALKNCEPMIGLVPILKGGRFYQVNEWPGQESRALHM

SEQ ID NO: 52233 - protein, 271 aa, Homo sapiens
  Payload ID: 10407
  Gene Symbol: MRPS7
  Gene Name: mitochondrial ribosomal protein S7
  ENSP ID: ENSP00000463683
MSSYLGQGPELLWLRFSSRSPRRSPSSARWQSCLLLSQTYSLVESAFACLLLSPPPRLTQVRWSRYSPEFKDPLIDKEYYRKPVEELTEEEKYVRELKKTQLIKAAPAGKTSSVFEDPVISKFTNMMMIGGNKVLARSLMIQTLEAVKRKQFEKYHAASAEEQATIERNPYTIFHQALKNCEPMIGLVPILKGGRFYQVPVPLPDRRRRFLAMKWMITECRDKKHQRTLMPEKLSHKLLEAFHNQGPVIKRKHDLHKMAEANRALAHYRWW

SEQ ID NO: 52234 - protein, 172 aa, Homo sapiens
  Payload ID: 10407
  Gene Symbol: MRPS7
  Gene Name: mitochondrial ribosomal protein S7
  ENSP ID: ENSP00000463870
  MOD_RES (1)..(1): Any amino acid
XQLIKAAPAGKTSSVFEDPVISKFTNMMMIGGNKVLARSLMIQTLEAVKRKQFEKYHAASAEEQATIERNPYTIFHQALKNCEPMIGLVPILKGGRFYQVPVPLPDRRRRFLAMKWMITECRDKKHQRTLMPEKLSHKLLEAFHNQGPVIKRKHDLHKMAEANRALAHYRWW

SEQ ID NO: 52235 - protein, 396 aa, Homo sapiens
  Payload ID: 10408
  Gene Symbol: MRPS9
  Gene Name: mitochondrial ribosomal protein S9
  Uniprot ID: P82933
  ENSP ID: ENSP00000258455
MAAPCVSYGGAVSYRLLLWGRGSLARKQGLWKTAAPELQTNVRSQILRLRHTAFVIPKKNVPTSKRETYTEDFIKKQIEEFNIGKRHLANMMGEDPETFTQEDIDRAIAYLFPSGLFEKRARPVMKHPEQIFPRQRAIQWGEDGRPFHYLFYTGKQSYYSLMHDVYGMLLNLEKHQSHLQAKSLLPEKTVTRDVIGSRWLIKEELEEMLVEKLSDLDYMQFIRLLEKLLTSQCGAAEEEFVQRFRRSVTLESKKQLIEPVQYDEQGMAFSKSEGKRKTAKAEAIVYKHGSGRIKVNGIDYQLYFPITQDREQLMFPFHFVDRLGKHDVTCTVSGGGRSAQAGAIRLAMAKALCSFVTEDEVEWMRQAGLLTTDPRVRERKKPGQEGARRKFTWKKR

SEQ ID NO: 52236 - protein, 57 aa, Homo sapiens
  Payload ID: 10408
  Gene Symbol: MRPS9
  Gene Name: mitochondrial ribosomal protein S9
  ENSP ID: ENSP00000388885
  MOD_RES (1)..(1): Any amino acid
XQSHLQAKSLLPEKTVTRDVIGSRWLIKEELEEMLVEKLSDLDVQKSLRVCEMQSRE

SEQ ID NO: 52237 - protein, 210 aa, Homo sapiens
  Payload ID: 10409
  Gene Symbol: MRRF
  Gene Name: mitochondrial ribosome recycling factor
  Uniprot ID: Q96E11
  ENSP ID: ENSP00000297908
MALGLKCFRMVHPTFRNYLAASIRPVSEVTLKTVHERQHGHRQYMAYSAVPVRHFATKKAKGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 52238 - protein, 262 aa, Homo sapiens
  Payload ID: 10409
  Gene Symbol: MRRF
  Gene Name: mitochondrial ribosome recycling factor
  Uniprot ID: Q96E11
  ENSP ID: ENSP00000343867
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 52239 - protein, 201 aa, Homo sapiens
  Payload ID: 10409
  Gene Symbol: MRRF
  Gene Name: mitochondrial ribosome recycling factor
  Uniprot ID: Q96E11
  ENSP ID: ENSP00000362828
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQSAKWPMTQWQNWTGIWQ

SEQ ID NO: 52240 - protein, 218 aa, Homo sapiens
  Payload ID: 10409
  Gene Symbol: MRRF
  Gene Name: mitochondrial ribosome recycling factor
  Uniprot ID: Q96E11
  ENSP ID: ENSP00000362834
MAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 52241 - protein, 201 aa, Homo sapiens; identical to SEQ ID NO: 52239
  Payload ID: 10409
  Gene Symbol: MRRF
  Gene Name: mitochondrial ribosome recycling factor
  Uniprot ID: Q96E11
  ENSP ID: ENSP00000377850

SEQ ID NO: 52242 - protein, 153 aa, Homo sapiens
  Payload ID: 10409
  Gene Symbol: MRRF
  Gene Name: mitochondrial ribosome recycling factor
  ENSP ID: ENSP00000395072
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPE

SEQ ID NO: 52243 - protein, 176 aa, Homo sapiens
  Payload ID: 10409
  Gene Symbol: MRRF
  Gene Name: mitochondrial ribosome recycling factor
  Uniprot ID: Q96E11
  ENSP ID: ENSP00000433288
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPEELAWIRSLRVPGIRSHLYHQLAV

SEQ ID NO: 52244 - protein, 168 aa, Homo sapiens
  Payload ID: 10409
  Gene Symbol: MRRF
  Gene Name: mitochondrial ribosome recycling factor
  Uniprot ID: Q96E11
  ENSP ID: ENSP00000434807
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPETMKQIKQYFNGPNVA

SEQ ID NO: 52245 - protein, 168 aa, Homo sapiens; identical to SEQ ID NO: 52244
  Payload ID: 10409
  Gene Symbol: MRRF
  Gene Name: mitochondrial ribosome recycling factor
  Uniprot ID: Q96E11
  ENSP ID: ENSP00000436360

SEQ ID NO: 52246 - protein, 334 aa, Homo sapiens
  Payload ID: 10410
  Gene Symbol: MTG1
  Gene Name: mitochondrial ribosome-associated GTPase 1
  Uniprot ID: Q9BT17
  ENSP ID: ENSP00000323047
MRLTPRALCSAAQAAWRENFPLCGRDVARWFPGHMAKGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKGKATRVGGEPGITRAVMSKIQVSERPLMFLLDTPGVLAPRIESVETGLKLALCGTVLDHLVGEETMADYLLYTLNKHQRFGYVQHYGLGSACDNVERVLKSVAVKLGKTQKVKVLTGTGNVNIIQPNYPAAARDFLQTFRRGLLGSVMLDLDVLRGHPPAETLP

SEQ ID NO: 52247 - protein, 283 aa, Homo sapiens
  Payload ID: 10410
  Gene Symbol: MTG1
  Gene Name: mitochondrial ribosome-associated GTPase 1
  ENSP ID: ENSP00000393480
MRLTPRALCSAAQAAWRENFPLCGRDVARWFPGHMAKGLKKMQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKEVSERPLMFLLDTPGVLAPRIESVETGLKLALCGTVLDHLVGEETMADYLLYTLNKHQRFGYVQHYGLGSACDNVERVLKSVAVKLGKTQKVKVLTGTGNVNIIQPNYPAAARDFLQTFRRGLLGSVMLDLDVLRGHPPAETLP

SEQ ID NO: 52248 - protein, 293 aa, Homo sapiens
  Payload ID: 10410
  Gene Symbol: MTG1
  Gene Name: mitochondrial ribosome-associated GTPase 1
  ENSP ID: ENSP00000475596
MQSSLKLVDCIIEVHDARIPLSGRNPLFQETLGLKPHLLVLNKMDLADLTEQQKIMQHLEGEGLKNVIFTNCVKDENVKQIIPMVTELIGRSHRYHRKENLEYCIMVIGVPNVGKSSLINSLRRQHLRKGKATRVGGEPGITRAVMSKIQVSERPLMFLLDTPGVLAPRIESVETGLKLALCGTVLDHLVGEETMADYLLYTLNKHQRFGYVQHYGLGSACDNVERVLKSVAVKLGKTQKVKVLTGTGNVNIIQPNYPAAARDFLQTFRRGLLGSVMLDLDVLRGHPPAETLP

SEQ ID NO: 52249 - protein, 406 aa, Homo sapiens
  Payload ID: 10411
  Gene Symbol: MTG2
  Gene Name: mitochondrial ribosome-associated GTPase 2
  Uniprot ID: Q9H4K7
  ENSP ID: ENSP00000359859
MAPARCFSARLRTVFQGVGHWALSTWAGLKPSRLLPQRASPRLLSVGRADLAKHQELPGKKLLSEKKLKRYFVDYRRVLVCGGNGGAGASCFHSEPRKEFGGPDGGDGGNGGHVILRVDQQVKSLSSVLSRYQGFSGEDGGSKNCFGRSGAVLYIRVPVGTLVKEGGRVVADLSCVGDEYIAALGGAGGKGNRFFLANNNRAPVTCTPGQPGQQRVLHLELKTVAHAGMVGFPNAGKSSLLRAISNARPAVASYPFTTLKPHVGIVHYEGHLQIAVADIPGIIRGAHQNRGLGSAFLRHIERCRFLLFVVDLSQPEPWTQVDDLKYELEMYEKGLSARPHAIVANKIDLPEAQANLSQLRDHLGQEVIVLSALTGENLEQLLLHLKVLYDAYAEAELGQGRQPLRW

SEQ ID NO: 52250 - protein, 233 aa, Homo sapiens
  Payload ID: 10411
  Gene Symbol: MTG2
  Gene Name: mitochondrial ribosome-associated GTPase 2
  ENSP ID: ENSP00000414693
MAPARCFSARLRTVFQGVGHWALSTWAGLKPSRLLPQRASPRLLSVGRADLAKHQELPGKKLLSEKKLKRYFVDYRRVLVCGGNGGAGASCFHSEPRKEFGGPDGGDGGNGGHVILRVDQQVKSLSSVLSRYQGFSGEDGGSKNCFGRSGAVLYIRVPVGTLVKEGGRVVADLSCVGDEYIAALGGAGGKGNRFFLANNNRAPVTCTPGQPGQQRVLHLELKTVAHAGMVGFP

SEQ ID NO: 52251 - protein, 139 aa, Homo sapiens
  Payload ID: 10411
  Gene Symbol: MTG2
  Gene Name: mitochondrial ribosome-associated GTPase 2
  ENSP ID: ENSP00000435214
MAPARCFSARLRTVFQGVGHWALSTWAGLKPSRLLPQRASPRLLSVGRADLAKHQELPGKKLLSEKKLKRYFVDYRRVLVCGGNGGAGASCFHSEPRKEFGGPDGGDGGNGGHVILRGPRGHAGEGGRQSCGRPVLRGR

SEQ ID NO: 52252 - protein, 353 aa, Homo sapiens
  Payload ID: 10412
  Gene Symbol: MRM1
  Gene Name: mitochondrial rRNA methyltransferase 1
  Uniprot ID: Q6IN84
  ENSP ID: ENSP00000478520
MALLSTVRGATWGRLVTRHFSHAARHGERPGGEELSRLLLDDLVPTSRLELLFGMTPCLLALQAARRSVARLLLQAGKAGLQGKRAELLRMAEARDIPVLRPRRQKLDTMCRYQVHQGVCMEVSPLRPRPWREAGEASPGDDPQQLWLVLDGIQDPRNFGAVLRSAHFLGVDKVITSRRNSCPLTPVVSKSSAGAMEVMDVFSTDDLTGFLQTKAQQGWLVAGTVGCPSTEDPQSSEIPIMSCLEFLWERPTLLVLGNEGSGLSQEVQASCQLLLTILPRRQLPPGLESLNVSVAAGILLHSICSQRKGFPTEGERRQLLQDPQEPSARSEGLSMAQHPGLSSGPEKERQNEG

SEQ ID NO: 52253 - protein, 353 aa, Homo sapiens; identical to SEQ ID NO: 52252
  Payload ID: 10412
  Gene Symbol: MRM1
  Gene Name: mitochondrial rRNA methyltransferase 1
  Uniprot ID: Q6IN84
  ENSP ID: ENSP00000481559

SEQ ID NO: 52254 - protein, 158 aa, Homo sapiens
  Payload ID: 10412
  Gene Symbol: MRM1
  Gene Name: mitochondrial rRNA methyltransferase 1
  ENSP ID: ENSP00000482526
MEVMDVFSTDDLTGFLQTKAQQGWLVAGTVGCPSTEDPQSSEIPIMSCLEFLWERPTLLVLGNEGSGLSQEVQASCQLLLTILPRRQLPPGLESLNVSVAAGILLHSICSQRKGFPTEGERRQLLQDPQEPSARSEGLSMAQHPGLSSGPEKERQNEG

SEQ ID NO: 52255 - protein, 158 aa, Homo sapiens; identical to SEQ ID NO: 52254
  Payload ID: 10412
  Gene Symbol: MRM1
  Gene Name: mitochondrial rRNA methyltransferase 1
  ENSP ID: ENSP00000488408

SEQ ID NO: 52256 - protein, 373 aa, Homo sapiens
  Payload ID: 10413
  Gene Symbol: MECR
  Gene Name: mitochondrial trans-2-enoyl-CoA reductase
  Uniprot ID: Q9BV79
  ENSP ID: ENSP00000263702
MWVCSTLWRVRTPARQWRGLLPASGCHGPAASSYSASAEPARVRALVYGHHGDPAKVVELKNLELAAVRGSDVRVKMLAAPINPSDINMIQGNYGFLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLARGGTMVTYGGMAKQPVVASVSLLIFKDLKLRGFWLSQWKKDHSPDQFKELILTLCDLIRRGQLTAPACSQVPLQDYQSALEASMKPFISSKQILTM

SEQ ID NO: 52257 - protein, 297 aa, Homo sapiens
  Payload ID: 10413
  Gene Symbol: MECR
  Gene Name: mitochondrial trans-2-enoyl-CoA reductase
  Uniprot ID: Q9BV79
  ENSP ID: ENSP00000362896
MLAAPINPSDINMIQGNYGFLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLARGGTMVTYGGMAKQPVVASVSLLIFKDLKLRGFWLSQWKKDHSPDQFKELILTLCDLIRRGQLTAPACSQVPLQDYQSALEASMKPFISSKQILTM

SEQ ID NO: 52258 - protein, 212 aa, Homo sapiens
  Payload ID: 10413
  Gene Symbol: MECR
  Gene Name: mitochondrial trans-2-enoyl-CoA reductase
  ENSP ID: ENSP00000436831
VIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLARGGTMVTYGGMAKQPVVASVVSWVQREACLEPGQTPQPGHIPWHDSCLSLGNAPFLEGSLYP

SEQ ID NO: 52259 - protein, 399 aa, Homo sapiens
  Payload ID: 10414
  Gene Symbol: MTERF1
  Gene Name: mitochondrial transcription termination factor 1
  Uniprot ID: Q99551
  ENSP ID: ENSP00000248643
MQSLSLGQTSISKGLNYLTIMAPGNLWHMRNNFLFGSRCWMTRFSAENIFKSVSFRLFGVKCHNTDSEPLKNEDLLKNLLTMGVDIDMARKRQPGVFHRMITNEQDLKMFLLSKGASKEVIASIISRYPRAITRTPENLSKRWDLWRKIVTSDLEIVNILERSPESFFRSNNNLNLENNIKFLYSVGLTRKCLCRLLTNAPRTFSNSLDLNKQMVEFLQAAGLSLGHNDPADFVRKIIFKNPFILIQSTKRVKANIEFLRSTFNLNSEELLVLICGPGAEILDLSNDYARRSYANIKEKLFSLGCTEEEVQKFVLSYPDVIFLAEKKFNDKIDCLMEENISISQIIENPRVLDSSISTLKSRIKELVNAGCNLSTLNITLLSWSKKRYEAKLKKLSRFA

SEQ ID NO: 52260 - protein, 379 aa, Homo sapiens
  Payload ID: 10414
  Gene Symbol: MTERF1
  Gene Name: mitochondrial transcription termination factor 1
  ENSP ID: ENSP00000384986
MAPGNLWHMRNNFLFGSRCWMTRFSAENIFKSVSFRLFGVKCHNTDSEPLKNEDLLKNLLTMGVDIDMARKRQPGVFHRMITNEQDLKMFLLSKGASKEVIASIISRYPRAITRTPENLSKRWDLWRKIVTSDLEIVNILERSPESFFRSNNNLNLENNIKFLYSVGLTRKCLCRLLTNAPRTFSNSLDLNKQMVEFLQAAGLSLGHNDPADFVRKIIFKNPFILIQSTKRVKANIEFLRSTFNLNSEELLVLICGPGAEILDLSNDYARRSYANIKEKLFSLGCTEEEVQKFVLSYPDVIFLAEKKFNDKIDCLMEENISISQIIENPRVLDSSISTLKSRIKELVNAGCNLSTLNITLLSWSKKRYEAKLKKLSRFA

SEQ ID NO: 52261 - protein, 158 aa, Homo sapiens
  Payload ID: 10414
  Gene Symbol: MTERF1
  Gene Name: mitochondrial transcription termination factor 1
  ENSP ID: ENSP00000395097
MQSLSLGQTSISKGLNYLTIMAPGNLWHMRNNFLFGSRCWMTRFSAENIFKSVSFRLFGVKCHNTDSEPLKNEDLLKNLLTMGVDIDMARKRQPGVFHRMITNEQDLKMFLLSKGASKEVIASIISRYPRAITRTPENLSKRWDLWRKIVTSDLEIVN

SEQ ID NO: 52262 - protein, 26 aa, Homo sapiens
  Payload ID: 10414
  Gene Symbol: MTERF1
  Gene Name: mitochondrial transcription termination factor 1
  ENSP ID: ENSP00000400966
MAPGNLWHMRNNFLFGSRCWMTRFSA

SEQ ID NO: 52263 - protein, 139 aa, Homo sapiens
  Payload ID: 10414
  Gene Symbol: MTERF1
  Gene Name: mitochondrial transcription termination factor 1
  ENSP ID: ENSP00000402175
MAPGNLWHMRNNFLFGSRCWMTRFSAENIFKSVSFRLFGVKCHNTDSEPLKNEDLLKNLLTMGVDIDMARKRQPGVFHRMITNEQDLKMFLLSKGASKEVIASIISRYPRAITRTPENLSKRWDLWRKIVTSDLEIVNI

SEQ ID NO: 52264 - protein, 379 aa, Homo sapiens; identical to SEQ ID NO: 52260
  Payload ID: 10414
  Gene Symbol: MTERF1
  Gene Name: mitochondrial transcription termination factor 1
  ENSP ID: ENSP00000414116

SEQ ID NO: 52265 - protein, 385 aa, Homo sapiens
  Payload ID: 10415
  Gene Symbol: MTERF2
  Gene Name: mitochondrial transcription termination factor 2
  Uniprot ID: Q49AM1
  ENSP ID: ENSP00000240050
MLWKLLLRSQSCRLCSFRKMRSPPKYRPFLACFTYTTDKQSSKENTRTVEKLYKCSVDIRKIRRLKGWVLLEDETYVEEIANILQELGADETAVASILERCPEAIVCSPTAVNTQRKLWQLVCKNEEELIKLIEQFPESFFTIKDQENQKLNVQFFQELGLKNVVISRLLTAAPNVFHNPVEKNKQMVRILQESYLDVGGSEANMKVWLLKLLSQNPFILLNSPTAIKETLEFLQEQGFTSFEILQLLSKLKGFLFQLCPRSIQNSISFSKNAFKCTDHDLKQLVLKCPALLYYSVPVLEERMQGLLREGISIAQIRETPMVLELTPQIVQYRIRKLNSSGYRIKDGHLANLNGSKKEFEANFGKIQAKKVRPLFNPVAPLNVEE

SEQ ID NO: 52266 - protein, 385 aa, Homo sapiens; identical to SEQ ID NO: 52265
  Payload ID: 10415
  Gene Symbol: MTERF2
  Gene Name: mitochondrial transcription termination factor 2
  Uniprot ID: Q49AM1
  ENSP ID: ENSP00000376575

SEQ ID NO: 52267 - protein, 385 aa, Homo sapiens; identical to SEQ ID NO: 52265
  Payload ID: 10415
  Gene Symbol: MTERF2
  Gene Name: mitochondrial transcription termination factor 2
  Uniprot ID: Q49AM1
  ENSP ID: ENSP00000447651

SEQ ID NO: 52268 - protein, 33 aa, Homo sapiens
  Payload ID: 10415
  Gene Symbol: MTERF2
  Gene Name: mitochondrial transcription termination factor 2
  ENSP ID: ENSP00000448246
MLWKLLLRSQSCRLCSFRKMRSPPKYRPFLACF

SEQ ID NO: 52269 - protein, 178 aa, Homo sapiens
  Payload ID: 10415
  Gene Symbol: MTERF2
  Gene Name: mitochondrial transcription termination factor 2
  ENSP ID: ENSP00000448343
MLWKLLLRSQSCRLCSFRKMRSPPKYRPFLACFTYTTDKQSSKENTRTVEKLYKCSVDIRKIRRLKGWVLLEDETYVEEIANILQELGADETAVASILERCPEAIVCSPTAVNTQRKLWQLVCKNEEELIKLIEQFPESFFTIKDQENQKLNVQFFQELGLKNVVISRLLTAAPNVFH

SEQ ID NO: 52270 - protein, 86 aa, Homo sapiens
  Payload ID: 10415
  Gene Symbol: MTERF2
  Gene Name: mitochondrial transcription termination factor 2
  ENSP ID: ENSP00000448854
MLWKLLLRSQSCRLCSFRKMRSPPKYRPFLACFTYTTDKQSSKENTRTVEKLYKCSVDIRKIRRLKGWVLLEDETYVEEIANILQE

SEQ ID NO: 52271 - protein, 417 aa, Homo sapiens
  Payload ID: 10416
  Gene Symbol: MTERF3
  Gene Name: mitochondrial transcription termination factor 3
  Uniprot ID: Q96E29
  ENSP ID: ENSP00000287025
MALSAQQIPRWFNSVKLRSLINAAQLTKRFTRPARTLLHGFSAQPQISSDNCFLQWGFKTYRTSSLWNSSQSTSSSSQENNSAQSSLLPSMNEQSQKTQNISSFDSELFLEELDELPPLSPMQPISEEEAIQIIADPPLPPASFTLRDYVDHSETLQKLVLLGVDLSKIEKHPEAANLLLRLDFEKDIKQMLLFLKDVGIEDNQLGAFLTKNHAIFSEDLENLKTRVAYLHSKNFSKADVAQMVRKAPFLLNFSVERLDNRLGFFQKELELSVKKTRDLVVRLPRLLTGSLEPVKENMKVYRLELGFKHNEIQHMITRIPKMLTANKMKLTETFDFVHNVMSIPHHIIVKFPQVFNTRLFKVKERHLFLTYLGRAQYDPAKPNYISLDKLVSIPDEIFCEEIAKASVQDFEKFLKTL

SEQ ID NO: 52272 - protein, 173 aa, Homo sapiens
  Payload ID: 10416
  Gene Symbol: MTERF3
  Gene Name: mitochondrial transcription termination factor 3
  ENSP ID: ENSP00000429267
MLLFLKDVGIEDNQLGAFLTKNHAIFSEDLENLKTRVAYLHSKNFSKADVAQMVRKAPFLLNFSVERLDNRLGFFQKELELSVKKTRDLVVRLPRLLTGSLEPVKENMKVFNTRLFKVKERHLFLTYLGRAQYDPAKPNYISLDKLVSIPDEIFCEEIAKASVQDFEKFLKTL

SEQ ID NO: 52273 - protein, 361 aa, Homo sapiens
  Payload ID: 10416
  Gene Symbol: MTERF3
  Gene Name: mitochondrial transcription termination factor 3
  ENSP ID: ENSP00000429400
MALSAQQIPRWFNSVKLRSLINAAQLTKRFTRPARTLLHGFSAQPQISSDNCFLQWGFKTYRTSSLWNSSQSTSSSSQENNSAQSSLLPSMNEQSQKTQNISSFDSELFLEELDELPPLSPMQPISEEEAIQIIADPPLPPASFTLRDYVDHSETLQKLVLLGVDLSKIEKHPEAANLLLRLDFEKDIKQMLLFLKDVGIEDNQLGAFLTKNHAIFSEDLENLKTRVAYLHSKNFSKADVAQMVRKAPFLLNFSVERLDNRLGFFQKELELSVKKTRDLVVRLPRLLTGSLEPVKENMKVYRLELGFKHNEIQHMITRIPKMLTANKMKLTETFDFVHNVMSIPHHIIVKFPQFLHRKYRI

SEQ ID NO: 52274 - protein, 67 aa, Homo sapiens
  Payload ID: 10416
  Gene Symbol: MTERF3
  Gene Name: mitochondrial transcription termination factor 3
  ENSP ID: ENSP00000429526
MALSAQQIPRWFNSVKLRSLINAAQLTKRFTRPARTLLHGFSAQPQISSDNCFLQWGFKTYRTSSLW

SEQ ID NO: 52275 - protein, 296 aa, Homo sapiens
  Payload ID: 10416
  Gene Symbol: MTERF3
  Gene Name: mitochondrial transcription termination factor 3
  Uniprot ID: Q96E29
  ENSP ID: ENSP00000430138
MQPISEEEAIQIIADPPLPPASFTLRDYVDHSETLQKLVLLGVDLSKIEKHPEAANLLLRLDFEKDIKQMLLFLKDVGIEDNQLGAFLTKNHAIFSEDLENLKTRVAYLHSKNFSKADVAQMVRKAPFLLNFSVERLDNRLGFFQKELELSVKKTRDLVVRLPRLLTGSLEPVKENMKVYRLELGFKHNEIQHMITRIPKMLTANKMKLTETFDFVHNVMSIPHHIIVKFPQVFNTRLFKVKERHLFLTYLGRAQYDPAKPNYISLDKLVSIPDEIFCEEIAKASVQDFEKFLKTL

SEQ ID NO: 52276 - protein, 381 aa, Homo sapiens
  Payload ID: 10417
  Gene Symbol: MTERF4
  Gene Name: mitochondrial transcription termination factor 4
  Uniprot ID: Q7Z6M4
  ENSP ID: ENSP00000241527
MAAFGRQVLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEGKLKRVLYCCPEIFTMRQQDINDTVRLLKEKCLFTVQQVTKILHSCPSVLREDLGQLEYKFQYAYFRMGIKHPDIVKSEYLQYSLTKIKQRHIYLERLGRYQTPDKKGQTQIPNPLLKDILRVSEAEFLARTACTSVEEFQVFKKLLAREEEESESSTSDDKRASLDEDEDDDDEEDNDEDDNDEDDDDEDDDEAEDNDEDEDDDEEE

SEQ ID NO: 52277 - protein, 381 aa, Homo sapiens; identical to SEQ ID NO: 52276
  Payload ID: 10417
  Gene Symbol: MTERF4
  Gene Name: mitochondrial transcription termination factor 4
  Uniprot ID: Q7Z6M4
  ENSP ID: ENSP00000375840

SEQ ID NO: 52278 - protein, 193 aa, Homo sapiens
  Payload ID: 10417
  Gene Symbol: MTERF4
  Gene Name: mitochondrial transcription termination factor 4
  ENSP ID: ENSP00000384998
MRQQDINDTVRLLKEKCLFTVQQVTKILHSCPSVLREDLGQLEYKFQYAYFRMGIKHPDIVKSEYLQYSLTKIKQRHIYLERLGRYQTPDKKGQTQIPNPLLKDILRVSEAEFLARTACTSVEEFQVFKKLLAREEEESESSTSDDKRASLDEDEDDDDEEDNDEDDNDEDDDDEDDDEAEDNDEDEDDDEEE

SEQ ID NO: 52279 - protein, 182 aa, Homo sapiens
  Payload ID: 10417
  Gene Symbol: MTERF4
  Gene Name: mitochondrial transcription termination factor 4
  ENSP ID: ENSP00000385183
MAAFGRQVLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEAASSYSVTA

SEQ ID NO: 52280 - protein, 252 aa, Homo sapiens
  Payload ID: 10417
  Gene Symbol: MTERF4
  Gene Name: mitochondrial transcription termination factor 4
  ENSP ID: ENSP00000385630
MAAFGRQVLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEGKLKRVLYCCPEIFTMRQQDINDTVRLLKEKCLFTVQQVTKILHSCPSVLREDLGQLEYKFQVRMTDSVISVVSGENDW

SEQ ID NO: 52281 - protein, 151 aa, Homo sapiens
  Payload ID: 10417
  Gene Symbol: MTERF4
  Gene Name: mitochondrial transcription termination factor 4
  ENSP ID: ENSP00000393063
MARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLG

SEQ ID NO: 52282 - protein, 152 aa, Homo sapiens
  Payload ID: 10417
  Gene Symbol: MTERF4
  Gene Name: mitochondrial transcription termination factor 4
  ENSP ID: ENSP00000401409
SYLQKLGLGEGKLKRVLYCCPEIFTMRQQDINDTVRLLKEKCLFTVQQVTKILHSCPSVLREDLGQLEYKFQYAYFRMGIKHPDIVKTASSYSVTAKKKTFVLQKKSSSVTPSTSPQLSQMAVAVLCQWKEFLLRGGAGGLIYYCATASPAH

SEQ ID NO: 52283 - protein, 257 aa, Homo sapiens
  Payload ID: 10417
  Gene Symbol: MTERF4
  Gene Name: mitochondrial transcription termination factor 4
  ENSP ID: ENSP00000409023
VLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEGKLKRVLYCCPEIFTMRQQDINDTVRLLKEKCLFTVQQVTKILHSCPSVLREDLGQLEYKFQKNTTSSFCPFSLLPLFPPTPLFPAPCFSG

SEQ ID NO: 52284 - protein, 107 aa, Homo sapiens
  Payload ID: 10417
  Gene Symbol: MTERF4
  Gene Name: mitochondrial transcription termination factor 4
  ENSP ID: ENSP00000413346
SSSVTPSTSPQLSQMAVAVLCQWKEFLLRGGAGECTPSTYEKKLTIKWPQAGPSGGFQKKASLSQEVAAPCVLLGHDVEVEEGDMDDPAPVTNLLLCNCQSCAFQLR

SEQ ID NO: 52285 - protein, 187 aa, Homo sapiens
  Payload ID: 10417
  Gene Symbol: MTERF4
  Gene Name: mitochondrial transcription termination factor 4
  ENSP ID: ENSP00000414989
MAAFGRQMAPPGCRKTSSGLPVILHYGKLKRVLYCCPEIFTMRQQDINDTVRLLKEKCLFTVQQVTKILHSCPSVLREDLGQLEYKFQYAYFRMGIKHPDIVKSEYLQYSLTKIKQRHIYLERLGRYQTPDKKGQTQIPNPLLKDILRVSEAEFLARTACTSVEEFQVFKKLLAREEEESESSTSDD

SEQ ID NO: 52286 - protein, 249 aa, Homo sapiens
  Payload ID: 10417
  Gene Symbol: MTERF4
  Gene Name: mitochondrial transcription termination factor 4
  ENSP ID: ENSP00000419315
MAAFGRQVLDWHRLIPLTWACMARQTPHLGEQRRTTASLLRKLTTASNGGVIEELSCVRSNNYVQEPECRRNLVQCLLEKQGTPVVQGSLELERVMSSLLDMGFSNAHINELLSVRRGASLQQLLDIISEFILLGLNPEPVCVVLKKSPQLLKLPIMQMRKRSSYLQKLGLGEECTPSTYEKKLTIKWPQAGPSGGFQKKASLSQEVAAPCVLLGHDVEVEEGLIYYCATASPAHSSYAKRPAQARNKT

SEQ ID NO: 52287 - protein, 381 aa, Homo sapiens; identical to SEQ ID NO: 52276
  Payload ID: 10417
  Gene Symbol: MTERF4
  Gene Name: mitochondrial transcription termination factor 4
  Uniprot ID: Q7Z6M4
  ENSP ID: ENSP00000480378

SEQ ID NO: 52288 - protein, 727 aa, Homo sapiens
  Payload ID: 10418
  Gene Symbol: MTIF2
  Gene Name: mitochondrial translational initiation factor 2
  Uniprot ID: P46199
  ENSP ID: ENSP00000263629
MNQKLLKLENLLRFHTIYRQLHSLCQRRALRQWRHGFSSAYPVWTAQLCAWPWPTDVLTGAALSQYRLLVTKKEEGPWKSQLSSTKSKKVVEVWIGMTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKVRLMFDENGKTIDEAYPSMPVGITGWRDLPSAGEEILEVESEPRAREVVDWRKYEQEQEKGQEDLKIIEEKRKEHKEAHQKAREKYGHLLWKKRSILRFLERKEQIPLKPKEKRERDSNVLSVIIKGDVDGSVEAILNIIDTYDASHECELELVHFGVGDVSANDVNLAETFDGVIYGFNVNAGNVIQQSAAKKGVKIKLHKIIYRLVEDLQEELSSRLPCAVEEHPVGEASILATFSVTEGKKKVPVAGCRVQKGQLEKQKKFKLTRNGHVIWKGSLTSLKHHKDDISIVKTGMDCGLSLDEDNMEFQVGDRIVCYEEKQIQAKTSWDPGF

SEQ ID NO: 52289 - protein, 727 aa, Homo sapiens; identical to SEQ ID NO: 52288
  Payload ID: 10418
  Gene Symbol: MTIF2
  Gene Name: mitochondrial translational initiation factor 2
  Uniprot ID: P46199
  ENSP ID: ENSP00000378099

SEQ ID NO: 52290 - protein, 70 aa, Homo sapiens
  Payload ID: 10418
  Gene Symbol: MTIF2
  Gene Name: mitochondrial translational initiation factor 2
  ENSP ID: ENSP00000383880
MNQKLLKLENLLRFHTIYRQLHSLCQRRALRQWRHGFSSAYPVWTAQLCAWPWPTDVLTGAALSQYRLLV

SEQ ID NO: 52291 - protein, 727 aa, Homo sapiens; identical to SEQ ID NO: 52288
  Payload ID: 10418
  Gene Symbol: MTIF2
  Gene Name: mitochondrial translational initiation factor 2
  Uniprot ID: P46199
  ENSP ID: ENSP00000384481

SEQ ID NO: 52292 - protein, 70 aa, Homo sapiens; identical to SEQ ID NO: 52290
  Payload ID: 10418
  Gene Symbol: MTIF2
  Gene Name: mitochondrial translational initiation factor 2
  ENSP ID: ENSP00000388640

SEQ ID NO: 52293 - protein, 7 aa, Homo sapiens
  Payload ID: 10418
  Gene Symbol: MTIF2
  Gene Name: mitochondrial translational initiation factor 2
  ENSP ID: ENSP00000393025
MNQKLLK

SEQ ID NO: 52294 - protein, 72 aa, Homo sapiens
  Payload ID: 10418
  Gene Symbol: MTIF2
  Gene Name: mitochondrial translational initiation factor 2
  ENSP ID: ENSP00000393337
MNQKLLKLENLLRFHTIYRQLHSLCQRRALRQWRHGFSSAYPVWTAQLCAWPWPTDVLTGAALSQYRLLVTK

SEQ ID NO: 52295 - protein, 10 aa, Homo sapiens
  Payload ID: 10418
  Gene Symbol: MTIF2
  Gene Name: mitochondrial translational initiation factor 2
  ENSP ID: ENSP00000399531
MNQKLLKLEN

SEQ ID NO: 52296 - protein, 301 aa, Homo sapiens
  Payload ID: 10418
  Gene Symbol: MTIF2
  Gene Name: mitochondrial translational initiation factor 2
  ENSP ID: ENSP00000403492
  MOD_RES (1)..(1): Any amino acid
XPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKPRAREVVDWRKYEQEQEKGQEDLKIIEEKRKEHKEAHQKAREKYGHLLWKKRSILRFLERKEQIPLKPKEKRERDSNVLSVIIKGDVDGSVEAILNIIDTYDASHECELELVHFGVGDVSANDVNLAETFDGVIYGFNVNAGNVIQQSAAKKGVKIKLHKIIYRLVEDLQEELSSRLPCAVEEHPV

SEQ ID NO: 52297 - protein, 26 aa, Homo sapiens
  Payload ID: 10418
  Gene Symbol: MTIF2
  Gene Name: mitochondrial translational initiation factor 2
  ENSP ID: ENSP00000416057
MNQKLLKLENLLRFHTIYRQLHSLCQ

SEQ ID NO: 52298 - protein, 278 aa, Homo sapiens
  Payload ID: 10419
  Gene Symbol: MTIF3
  Gene Name: mitochondrial translational initiation factor 3
  Uniprot ID: Q9H2K0
  ENSP ID: ENSP00000370508
MAALFLKRLTLQTVKSENSCIRCFGKHILQKTAPAQLSPIASAPRLSFLIHAKAFSTAEDTQNEGKKTKKNKTAFSNVGRKISQRVIHLFDEKGNDLGNMHRANVIRLMDERDLRLVQRNTSTEPAEYQLMTGLQILQERQRLREMEKANPKTGPTLRKELILSSNIGQHDLDTKTKQIQQWIKKKHLVQITIKKGKNVDVSENEMEEIFHQILQTMPGIATFSSRPQAVQGGKALMCVLRAFSKNEEKAYKETQETQERDTLNKDHGNDKESNVLHQ

SEQ ID NO: 52299 - protein, 278 aa, Homo sapiens; identical to SEQ ID NO: 52298
  Payload ID: 10419
  Gene Symbol: MTIF3
  Gene Name: mitochondrial translational initiation factor 3
  Uniprot ID: Q9H2K0
  ENSP ID: ENSP00000370512

SEQ ID NO: 52300 - protein, 278 aa, Homo sapiens; identical to SEQ ID NO: 52298
  Payload ID: 10419
  Gene Symbol: MTIF3
  Gene Name: mitochondrial translational initiation factor 3
  Uniprot ID: Q9H2K0
  ENSP ID: ENSP00000384659

SEQ ID NO: 52301 - protein, 445 aa, Homo sapiens
  Payload ID: 10420
  Gene Symbol: MTRF1
  Gene Name: mitochondrial translational release factor 1
  Uniprot ID: O75570
  ENSP ID: ENSP00000368790
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKSLNKQDEKQLQELALEERQTIDQKINMLYNELFQSLVPKEKYDKNDVILEVTAGRTTGGDICQQFTREIFDMYQNYSCYKHWQFELLNYTPADYGGLHHAAARISGDGVYKHLKYEGGIHRVQRIPEVGLSSRMQRIHTGTMSVIVLPQPDEVDVKLDPKDLRIDTFRAKGAGGQHVNKTDSAVRLVHIPTGLVVECQQERSQIKNKEIAFRVLRARLYQQIIEKDKRQQQSARKLQVGTRAQSERIRTYNFTQDRVSDHRIAYEVRDIKEFLCGGKGLDQLIQRLLQSADEEAIAELLDEHLKSAK

SEQ ID NO: 52302 - protein, 445 aa, Homo sapiens; identical to SEQ ID NO: 52301
  Payload ID: 10420
  Gene Symbol: MTRF1
  Gene Name: mitochondrial translational release factor 1
  Uniprot ID: O75570
  ENSP ID: ENSP00000368793

SEQ ID NO: 52303 - protein, 226 aa, Homo sapiens
  Payload ID: 10420
  Gene Symbol: MTRF1
  Gene Name: mitochondrial translational release factor 1
  ENSP ID: ENSP00000399279
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKSLNKQDEKQLQELALEERQTIDQKINMLYNELFQSLVPKEKYDKNDVILEVTAGRTTGGDICQQFTREIFDMYQNYSCYKHWQFELLN

SEQ ID NO: 52304 - protein, 151 aa, Homo sapiens
  Payload ID: 10420
  Gene Symbol: MTRF1
  Gene Name: mitochondrial translational release factor 1
  ENSP ID: ENSP00000400031
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKKTESCSVAQAGMQ

SEQ ID NO: 52305 - protein, 151 aa, Homo sapiens; identical to SEQ ID NO: 52304
  Payload ID: 10420
  Gene Symbol: MTRF1
  Gene Name: mitochondrial translational release factor 1
  ENSP ID: ENSP00000481161

SEQ ID NO: 52306 - protein, 137 aa, Homo sapiens
  Payload ID: 10420
  Gene Symbol: MTRF1
  Gene Name: mitochondrial translational release factor 1
  ENSP ID: ENSP00000482339
RRHAELAPLAAIYQEIQETEQAIEELESMCKSLNKQDEKQLQELALEERQTIDQKINMLYNELFQSLVPKEKYDKNDVILEVTAGRTTGGDICQQFTREIFDMYQNYSCYKHWQFELLNYTPADYGRHIEEFACRRY

SEQ ID NO: 52307 - protein, 153 aa, Homo sapiens
  Payload ID: 10420
  Gene Symbol: MTRF1
  Gene Name: mitochondrial translational release factor 1
  ENSP ID: ENSP00000484414
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKRDRVLLCGPGWNAVV

SEQ ID NO: 52308 - protein, 235 aa, Homo sapiens
  Payload ID: 10421
  Gene Symbol: MTRF1L
  Gene Name: mitochondrial translational release factor 1-like
  Uniprot ID: Q9UGC7
  ENSP ID: ENSP00000356199
MRSRVLWGAARWLWPRRAVGPARRPLSSGSPPLEELFTRGGPLRTFLERQAGSEAHLKVRRPELLAVIKLLNEKERELRETEHLLHDENEDLRKLAENEITLCQKEITQLKHQIILLLVPSEETDENDLILEVTAGVGGGLRHASASIGGSEAYRHMKFEGGVHRVQRVPKTEKQGRVHTSTMTVAILPQPTEINLVINPKDLRIDTKRASGAGGQHVNTTDSAVRIVHLPTDWK

SEQ ID NO: 52309 - protein, 271 aa, Homo sapiens
  Payload ID: 10421
  Gene Symbol: MTRF1L
  Gene Name: mitochondrial translational release factor 1-like
  Uniprot ID: Q9UGC7
  ENSP ID: ENSP00000356200
MRSRVLWGAARWLWPRRAVGPARRPLSSGSPPLEELFTRGGPLRTFLERQAGSEAHLKVRRPELLAVIKLLNEKERELRETEHLLHDENEDLRKLAENEITLCQKEITQLKHQIILLLVPSEETDENDLILEVTAGVGGQEAMLFTSEIFDMYQQYAAFKRWHFETLEYFPSELGGLRHASASIGGSEAYRHMKFEGGVHRVQRVPKTEKQGRVHTSTMTVAILPQPTEINLVINPKDLRIDTKRASGAGGQHVNTTDSAVRIVHLPTDWK

SEQ ID NO: 52310 - protein, 380 aa, Homo sapiens
  Payload ID: 10421
  Gene Symbol: MTRF1L
  Gene Name: mitochondrial translational release factor 1-like
  Uniprot ID: Q9UGC7
  ENSP ID: ENSP00000356202
MRSRVLWGAARWLWPRRAVGPARRPLSSGSPPLEELFTRGGPLRTFLERQAGSEAHLKVRRPELLAVIKLLNEKERELRETEHLLHDENEDLRKLAENEITLCQKEITQLKHQIILLLVPSEETDENDLILEVTAGVGGQEAMLFTSEIFDMYQQYAAFKRWHFETLEYFPSELGGLRHASASIGGSEAYRHMKFEGGVHRVQRVPKTEKQGRVHTSTMTVAILPQPTEINLVINPKDLRIDTKRASGAGGQHVNTTDSAVRIVHLPTGVVSECQQERSQLKNKELAMTKLRAKLYSMHLEEEINKRQNARKIQIGSKGRSEKIRTYNFPQNRVTDHRINKTLHDLETFMQGDYLLDELVQSLKEYADYESLVEIISQKV

SEQ ID NO: 52311 - protein, 231 aa, Homo sapiens
  Payload ID: 10421
  Gene Symbol: MTRF1L
  Gene Name: mitochondrial translational release factor 1-like
  ENSP ID: ENSP00000414383
IILLLVPSEETDENDLILEVTAGVGGGLRHASASIGGSEAYRHMKFEGGVHRVQRVPKTEKQGRVHTSTMTVAILPQPTEINLVINPKDLRIDTKRASGAGGQHVNTTDSAVRIVHLPTGVVSECQQERSQLKNKELAMTKLRAKLYSMHLEEEINKRQNARKIQIGSKGRSEKIRTYNFPQNRVTDHRINKTLHDLETFMQGDYLLDELVQSLKEYADYESLVEIISQKV

SEQ ID NO: 52312 - protein, 163 aa, Homo sapiens
  Payload ID: 10421
  Gene Symbol: MTRF1L
  Gene Name: mitochondrial translational release factor 1-like
  ENSP ID: ENSP00000415113
MFISFYDFKNIPQDSRCDGQLFINGRNNKNNSISLYFQGGLRHASASIGGSEAYRHMKFEGGVHRVQRVPKTEKQGRVHTSTMTVAILPQPTEINLVINPKDLRIDTKRASGAGGQHVNTTDSAVRIVHLPTGVVSECQQERSQLKNKELAMTKLRAKLYSMH

SEQ ID NO: 52313 - protein, 717 aa, Homo sapiens
  Payload ID: 10422
  Gene Symbol: MTO1
  Gene Name: mitochondrial tRNA translation optimization 1
  Uniprot ID: Q9Y2Z2
  ENSP ID: ENSP00000359323
MFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPDGVLLLLPRMECNGAISAHHNLPLPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 52314 - protein, 643 aa, Homo sapiens
  Payload ID: 10422
  Gene Symbol: MTO1
  Gene Name: mitochondrial tRNA translation optimization 1
  Uniprot ID: Q9Y2Z2
  ENSP ID: ENSP00000359328
MSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPDGVLLLLPRMECNGAISAHHNLPLPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 52315 - protein, 118 aa, Homo sapiens
  Payload ID: 10422
  Gene Symbol: MTO1
  Gene Name: mitochondrial tRNA translation optimization 1
  ENSP ID: ENSP00000396529
MSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLARRSAAMLLDSHQP

SEQ ID NO: 52316 - protein, 732 aa, Homo sapiens
  Payload ID: 10422
  Gene Symbol: MTO1
  Gene Name: mitochondrial tRNA translation optimization 1
  Uniprot ID: Q9Y2Z2
  ENSP ID: ENSP00000402038
MFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPGYGVQYDYLDPRQITPSLETHLVQRLFFAGQINGTTGYEEAAAQTECCSVARLECSDMISQLQAILLPQPSLVAGTAGMHHNTQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 52317 - protein, 98 aa, Homo sapiens
  Payload ID: 10422
  Gene Symbol: MTO1
  Gene Name: mitochondrial tRNA translation optimization 1
  ENSP ID: ENSP00000407580
EPEGMDSDLIYPQGLSMTLPAELQEKMITCIRGLEKAKVIQPGYGVQYDYLDPRQITPSLETHLVQRLFFAGQINGTTGYEEAAAQSVALLPGWSAVI

SEQ ID NO: 52318 - protein, 192 aa, Homo sapiens
  Payload ID: 10422
  Gene Symbol: MTO1
  Gene Name: mitochondrial tRNA translation optimization 1
  ENSP ID: ENSP00000416397
MFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLARRSAAMLLDSHQP

SEQ ID NO: 52319 - protein, 692 aa, Homo sapiens
  Payload ID: 10422
  Gene Symbol: MTO1
  Gene Name: mitochondrial tRNA translation optimization 1
  Uniprot ID: Q9Y2Z2
  ENSP ID: ENSP00000419561
MFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 52320 - protein, 110 aa, Homo sapiens
  Payload ID: 10422
  Gene Symbol: MTO1
  Gene Name: mitochondrial tRNA translation optimization 1
  ENSP ID: ENSP00000428302
MSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLGWSAVA

SEQ ID NO: 52321 - protein, 144 aa, Homo sapiens
  Payload ID: 10422
  Gene Symbol: MTO1
  Gene Name: mitochondrial tRNA translation optimization 1
  ENSP ID: ENSP00000428863
YIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEDRGC

SEQ ID NO: 52322 - protein, 95 aa, Homo sapiens
  Payload ID: 10422
  Gene Symbol: MTO1
  Gene Name: mitochondrial tRNA translation optimization 1
  ENSP ID: ENSP00000428903
MFYFRGCGRWVAVSFTKQQFPLARLSSDSAAPRTPHFDVIVIGGGHAGTEAATAAARCGSRTLLLTHRVDTIGEERGCCGTWRRTQAASFPPPPV

SEQ ID NO: 52323 - protein, 115 aa, Homo sapiens
  Payload ID: 10422
  Gene Symbol: MTO1
  Gene Name: mitochondrial tRNA translation optimization 1
  ENSP ID: ENSP00000429595
  MOD_RES (1)..(1): Any amino acid
XDDLTTLGTSEPYRMFTSRVEFRLSLRPDNADSRLTLRGYKDAGCVSQQRYERACWMKSSLEEGISVLKSIEFLSSKWKKLIPEASISTSRSLPVRRGGRHLNPSYLGGRGRRIV

SEQ ID NO: 52324 - protein, 86 aa, Homo sapiens
  Payload ID: 10422
  Gene Symbol: MTO1
  Gene Name: mitochondrial tRNA translation optimization 1
  ENSP ID: ENSP00000430660
  MOD_RES (1)..(1): Any amino acid
XVLLLLPRMECNGAISAHHNLPLPGYGVQYDYLDPRQITPSLETHLVQRLFFAGQINGTTGYEEAAAQGIKTLAVCPNNDMKELVG

SEQ ID NO: 52325 - protein, 226 aa, Homo sapiens
  Payload ID: 10423
  Gene Symbol: MT-ATP6
  Gene Name: mitochondrially encoded ATP synthase 6
  Uniprot ID: P00846
  ENSP ID: ENSP00000354632
MNENLFASFIAPTILGLPAAVLIILFPPLLIPTSKYLINNRLITTQQWLIKLTSKQMMTMHNTKGRTWSLMLVSLIIFIATTNLLGLLPHSFTPTTQLSMNLAMAIPLWAGTVIMGFRSKIKNALAHFLPQGTPTPLIPMLVIIETISLLIQPMALAVRLTANITAGHLLMHLIGSATLAMSTINLPSTLIIFTILILLTILEIAVALIQAYVFTLLVSLYLHDNT

SEQ ID NO: 52326 - protein, 68 aa, Homo sapiens
  Payload ID: 10424
  Gene Symbol: MT-ATP8
  Gene Name: mitochondrially encoded ATP synthase 8
  Uniprot ID: P03928
  ENSP ID: ENSP00000355265
MPQLNTTVWPTMITPMLLTLFLITQLKMLNTNYHLPPSPKPMKMKNYNKPWEPKWTKICSLHSLPPQS

SEQ ID NO: 52327 - protein, 380 aa, Homo sapiens
  Payload ID: 10425
  Gene Symbol: MT-CYB
  Gene Name: mitochondrially encoded cytochrome b
  Uniprot ID: P00156
  ENSP ID: ENSP00000354554
MTPMRKTNPLMKLINHSFIDLPTPSNISAWWNFGSLLGACLILQITTGLFLAMHYSPDASTAFSSIAHITRDVNYGWIIRYLHANGASMFFICLFLHIGRGLYYGSFLYSETWNIGIILLLATMATAFMGYVLPWGQMSFWGATVITNLLSAIPYIGTDLVQWIWGGYSVDSPTLTRFFTFHFILPFIIAALATLHLLFLHETGSNNPLGITSHSDKITFHPYYTIKDALGLLLFLLSLMTLTLFSPDLLGDPDNYTLANPLNTPPHIKPEWYFLFAYTILRSVPNKLGGVLALLLSILILAMIPILHMSKQQSMMFRPLSQSLYWLLAADLLILTWIGGQPVSYPFTIIGQVASVLYFTTILILMPTISLIENKMLKWA

SEQ ID NO: 52328 - protein, 513 aa, Homo sapiens
  Payload ID: 10426
  Gene Symbol: MT-CO1
  Gene Name: mitochondrially encoded cytochrome c oxidase I
  Uniprot ID: P00395
  ENSP ID: ENSP00000354499
MFADRWLFSTNHKDIGTLYLLFGAWAGVLGTALSLLIRAELGQPGNLLGNDHIYNVIVTAHAFVMIFFMVMPIMIGGFGNWLVPLMIGAPDMAFPRMNNMSFWLLPPSLLLLLASAMVEAGAGTGWTVYPPLAGNYSHPGASVDLTIFSLHLAGVSSILGAINFITTIINMKPPAMTQYQTPLFVWSVLITAVLLLLSLPVLAAGITMLLTDRNLNTTFFDPAGGGDPILYQHLFWFFGHPEVYILILPGFGMISHIVTYYSGKKEPFGYMGMVWAMMSIGFLGFIVWAHHMFTVGMDVDTRAYFTSATMIIAIPTGVKVFSWLATLHGSNMKWSAAVLWALGFIFLFTVGGLTGIVLANSSLDIVLHDTYYVVAHFHYVLSMGAVFAIMGGFIHWFPLFSGYTLDQTYAKIHFTIMFIGVNLTFFPQHFLGLSGMPRRYSDYPDAYTTWNILSSVGSFISLTAVMLMIFMIWEAFASKRKVLMVEEPSMNLEWLYGCPPPYHTFEEPVYMKS

SEQ ID NO: 52329 - protein, 227 aa, Homo sapiens
  Payload ID: 10427
  Gene Symbol: MT-CO2
  Gene Name: mitochondrially encoded cytochrome c oxidase II
  Uniprot ID: P00403
  ENSP ID: ENSP00000354876
MAHAAQVGLQDATSPIMEELITFHDHALMIIFLICFLVLYALFLTLTTKLTNTNISDAQEMETVWTILPAIILVLIALPSLRILYMTDEVNDPSLTIKSIGHQWYWTYEYTDYGGLIFNSYMLPPLFLEPGDLRLLDVDNRVVLPIEAPIRMMITSQDVLHSWAVPTLGLKTDAIPGRLNQTTFTATRPGVYYGQCSEICGANHSFMPIVLELIPLKIFEMGPVFTL

SEQ ID NO: 52330 - protein, 261 aa, Homo sapiens
  Payload ID: 10428
  Gene Symbol: MT-CO3
  Gene Name: mitochondrially encoded cytochrome c oxidase III
  Uniprot ID: P00414
  ENSP ID: ENSP00000354982
MTHQSHAYHMVKPSPWPLTGALSALLMTSGLAMWFHFHSMTLLMLGLLTNTLTMYQWWRDVTRESTYQGHHTPPVQKGLRYGMILFITSEVFFFAGFFWAFYHSSLAPTPQLGGHWPPTGITPLNPLEVPLLNTSVLLASGVSITWAHHSLMENNRNQMIQALLITILLGLYFTLLQASEYFESPFTISDGIYGSTFFVATGFHGLHVIIGSTFLTICFIRQLMFHFTSKHHFGFEAAAWYWHFVDVVWLFLYVSIYWWGS

SEQ ID NO: 52331 - protein, 318 aa, Homo sapiens
  Payload ID: 10429
  Gene Symbol: MT-ND1
  Gene Name: mitochondrially encoded NADH dehydrogenase 1
  Uniprot ID: P03886
  ENSP ID: ENSP00000354687
MPMANLLLLIVPILIAMAFLMLTERKILGYMQLRKGPNVVGPYGLLQPFADAMKLFTKEPLKPATSTITLYITAPTLALTIALLLWTPLPMPNPLVNLNLGLLFILATSSLAVYSILWSGWASNSNYALIGALRAVAQTISYEVTLAIILLSTLLMSGSFNLSTLITTQEHLWLLLPSWPLAMMWFISTLAETNRTPFDLAEGESELVSGFNIEYAAGPFALFFMAEYTNIIMMNTLTTTIFLGTTYDALSPELYTTYFVTKTLLLTSLFLWIRTAYPRFRYDQLMHLLWKNFLPLTLALLMWYVSMPITISSIPPQT

SEQ ID NO: 52332 - protein, 347 aa, Homo sapiens
  Payload ID: 10430
  Gene Symbol: MT-ND2
  Gene Name: mitochondrially encoded NADH dehydrogenase 2
  Uniprot ID: P03891
  ENSP ID: ENSP00000355046
MNPLAQPVIYSTIFAGTLITALSSHWFFTWVGLEMNMLAFIPVLTKKMNPRSTEAAIKYFLTQATASMILLMAILFNNMLSGQWTMTNTTNQYSSLMIMMAMAMKLGMAPFHFWVPEVTQGTPLTSGLLLLTWQKLAPISIMYQISPSLNVSLLLTLSILSIMAGSWGGLNQTQLRKILAYSSITHMGWMMAVLPYNPNMTILNLTIYIILTTTAFLLLNLNSSTTTLLLSRTWNKLTWLTPLIPSTLLSLGGLPPLTGFLPKWAIIEEFTKNNSLIIPTIMATITLLNLYFYLRLIYSTSITLLPMSNNVKMKWQFEHTKPTPFLPTLIALTTLLLPISPFMLMIL

SEQ ID NO: 52333 - protein, 115 aa, Homo sapiens
  Payload ID: 10431
  Gene Symbol: MT-ND3
  Gene Name: mitochondrially encoded NADH dehydrogenase 3
  Uniprot ID: P03897
  ENSP ID: ENSP00000355206
MNFALILMINTLLALLLMIITFWLPQLNGYMEKSTPYECGFDPMSPARVPFSMKFFLVAITFLLFDLEIALLLPLPWALQTTNLPLMVMSSLLLIIILALSLAYEWLQKGLDWTE

SEQ ID NO: 52334 - protein, 459 aa, Homo sapiens
  Payload ID: 10432
  Gene Symbol: MT-ND4
  Gene Name: mitochondrially encoded NADH dehydrogenase 4
  Uniprot ID: P03905
  ENSP ID: ENSP00000354961
MLKLIVPTIMLLPLTWLSKKHMIWINTTTHSLIISIIPLLFFNQINNNLFSCSPTFSSDPLTTPLLMLTTWLLPLTIMASQRHLSSEPLSRKKLYLSMLISLQISLIMTFTATELIMFYIFFETTLIPTLAIITRWGNQPERLNAGTYFLFYTLVGSLPLLIALIYTHNTLGSLNILLLTLTAQELSNSWANNLMWLAYTMAFMVKMPLYGLHLWLPKAHVEAPIAGSMVLAAVLLKLGGYGMMRLTLILNPLTKHMAYPFLVLSLWGMIMTSSICLRQTDLKSLIAYSSISHMALVVTAILIQTPWSFTGAVILMIAHGLTSSLLFCLANSNYERTHSRIMILSQGLQTLLPLMAFWWLLASLANLALPPTINLLGELSVLVTTFSWSNITLLLTGLNMLVTALYSLYMFTTTQWGSLTHHINNMKPSFTRENTLMFMHLSPILLLSLNPDIITGFSS

SEQ ID NO: 52335 - protein, 98 aa, Homo sapiens
  Payload ID: 10433
  Gene Symbol: MT-ND4L
  Gene Name: mitochondrially encoded NADH dehydrogenase 4L
  Uniprot ID: P03901
  ENSP ID: ENSP00000354728
MPLIYMNIMLAFTISLLGMLVYRSHLMSSLLCLEGMMLSLFIMATLMTLNTHSLLANIVPIAMLVFAACEAAVGLALLVSISNTYGLDYVHNLNLLQC

SEQ ID NO: 52336 - protein, 603 aa, Homo sapiens
  Payload ID: 10434
  Gene Symbol: MT-ND5
  Gene Name: mitochondrially encoded NADH dehydrogenase 5
  Uniprot ID: P03915
  ENSP ID: ENSP00000354813
MTMHTTMTTLTLTSLIPPILTTLVNPNKKNSYPHYVKSIVASTFIISLFPTTMFMCLDQEVIISNWHWATTQTTQLSLSFKLDYFSMMFIPVALFVTWSIMEFSLWYMNSDPNINQFFKYLLIFLITMLILVTANNLFQLFIGWEGVGIMSFLLISWWYARADANTAAIQAILYNRIGDIGFILALAWFILHSNSWDPQQMALLNANPSLTPLLGLLLAAAGKSAQLGLHPWLPSAMEGPTPVSALLHSSTMVVAGIFLLIRFHPLAENSPLIQTLTLCLGAITTLFAAVCALTQNDIKKIVAFSTSSQLGLMMVTIGINQPHLAFLHICTHAFFKAMLFMCSGSIIHNLNNEQDIRKMGGLLKTMPLTSTSLTIGSLALAGMPFLTGFYSKDHIIETANMSYTNAWALSITLIATSLTSAYSTRMILLTLTGQPRFPTLTNINENNPTLLNPIKRLAAGSLFAGFLITNNISPASPFQTTIPLYLKLTALAVTFLGLLTALDLNYLTNKLKMKSPLCTFYFSNMLGFYPSITHRTIPYLGLLTSQNLPLLLLDLTWLEKLLPKTISQHQISTSIITSTQKGMIKLYFLSFFFPLILTLLLIT

SEQ ID NO: 52337 - protein, 174 aa, Homo sapiens
  Payload ID: 10435
  Gene Symbol: MT-ND6
  Gene Name: mitochondrially encoded NADH dehydrogenase 6
  Uniprot ID: P03923
  ENSP ID: ENSP00000354665
MMYALFLLSVGLVMGFVGFSSKPSPIYGGLVLIVSGVVGCVIILNFGGGYMGLMVFLIYLGGMMVVFGYTTAMAIEEYPEAWGSGVEVLVSVLVGLAMEVGLVLWVKEYDGVVVVVNFNSVGSWMIYEGEGSGLIREDPIGAGALYDYGRWLVVVTGWTLFVGVYIVIEIARGN

SEQ ID NO: 52338 - protein, 240 aa, Homo sapiens
  Payload ID: 10436
  Gene Symbol: MGARP
  Gene Name: mitochondria-localized glutamic acid-rich protein
  Uniprot ID: Q8TDB4
  ENSP ID: ENSP00000381928
MYLRRAVSKTLALPLRAPPNPAPLGKDASLRRMSSNRFPGSSGSNMIYYLVVGVTVSAGGYYAYKTVTSDQAKHTEHKTNLKEKTKAEIHPFQGEKENVAETEKASSEAPEELIVEAEVVDAEESPSATVVVIKEASACPGHVEAAPETTAVSAETGPEVTDAAARETTEVNPETTPEVTNAALDEAVTIDNDKDTTKNETSDEYAELEEENSPAESESSAGDDLQEEASVGSEAASAQG

SEQ ID NO: 52339 - protein, 741 aa, Homo sapiens
  Payload ID: 10437
  Gene Symbol: MFN1
  Gene Name: mitofusin 1
  ENSP ID: ENSP00000263969
MAEPVSPLKHFVLAKKAITAIFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRHYSVEEREDQIDRLDFIRNQMNLLTLDVKKKIKEVTEEVANKVSCAMTDEICRLSVLVDEFCSEFHPNPDVLKIYKSELNKHIEDGMGRNLADRCTDEVNALVLQTQQEIIENLKPLLPAGIQDKLHTLIPCKKFDLSYNLNYHKLCSDFQEDIVFRFSLGWSSLVHRFLGPRNAQRVLLGLSEPIFQLPRSLASTPTAPTTPATPDNASQEELMITLVTGLASVTSRTSMGIIIVGGVIWKTIGWKLLSVSLTMYGALYLYERLSWTTHAKERAFKQQFVNYATEKLRMIVSSTSANCSHQVKQQIATTFARLCQQVDITQKQLEEEIARLPKEIDQLEKIQNNSKLLRNKAVQLENELENFTKQFLPSSNEES

SEQ ID NO: 52340 - protein, 370 aa, Homo sapiens
  Payload ID: 10437
  Gene Symbol: MFN1
  Gene Name: mitofusin 1
  Uniprot ID: Q8IWA4
  ENSP ID: ENSP00000349963
MAEPVSPLKHFVLAKKAITAIFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRFHVQ

SEQ ID NO: 52341 - protein, 154 aa, Homo sapiens
  Payload ID: 10437
  Gene Symbol: MFN1
  Gene Name: mitofusin 1
  ENSP ID: ENSP00000419134
MAEPVSPLKHFVLAKKAITAIFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKA

SEQ ID NO: 52342 - protein, 493 aa, Homo sapiens
  Payload ID: 10437
  Gene Symbol: MFN1
  Gene Name: mitofusin 1
  ENSP ID: ENSP00000419926
TVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRHYSVEEREDQIDRLDFIRNQMNLLTLDVKKKIKEVTEEVANKVSCAMTDEICRLSVLVDEFCSEFHPNPDVLKIYKSLPRSLASTPTAPTTPATPDNASQEELMITLVTGLASVTSRTSMGIIIVGGVIWKTIGWKLLSVSLTMYGALYLYERLSWTTHAKERAFKQQFVNYATEKLRMIVSSTSANCSHQVKQQIATTFARLCQQVDITQKQLEEEIARLPKEIDQLEKIQNNSKLLRNKAVQLENELENFTKQFLPSSNEES

SEQ ID NO: 52343 - protein, 124 aa, Homo sapiens
  Payload ID: 10437
  Gene Symbol: MFN1
  Gene Name: mitofusin 1
  ENSP ID: ENSP00000420148
MDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVV

SEQ ID NO: 52344 - protein, 741 aa, Homo sapiens; identical to SEQ ID NO: 52339
  Payload ID: 10437
  Gene Symbol: MFN1
  Gene Name: mitofusin 1
  ENSP ID: ENSP00000420617

SEQ ID NO: 52345 - protein, 757 aa, Homo sapiens
  Payload ID: 10438
  Gene Symbol: MFN2
  Gene Name: mitofusin 2
  Uniprot ID: O95140
  ENSP ID: ENSP00000235329
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMKVAFFGRTSNGKSTVINAMLWDKVLPSGIGHTTNCFLRVEGTDGHEAFLLTEGSEEKRSAKTVNQLAHALHQDKQLHAGSLVSVMWPNSKCPLLKDDLVLMDSPGIDVTTELDSWIDKFCLDADVFVLVANSESTLMQTEKHFFHKVSERLSRPNIFILNNRWDASASEPEYMEEVRRQHMERCTSFLVDELGVVDRSQAGDRIFFVSAKEVLNARIQKAQGMPEGGGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDVTRENLEQEIAAMNKKIEVLDSLQSKAKLLRNKAGWLDSELNMFTHQYLQPSR

SEQ ID NO: 52346 - protein, 98 aa, Homo sapiens
  Payload ID: 10438
  Gene Symbol: MFN2
  Gene Name: mitofusin 2
  ENSP ID: ENSP00000412023
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMK

SEQ ID NO: 52347 - protein, 757 aa, Homo sapiens; identical to SEQ ID NO: 52345
  Payload ID: 10438
  Gene Symbol: MFN2
  Gene Name: mitofusin 2
  Uniprot ID: O95140
  ENSP ID: ENSP00000416338

SEQ ID NO: 52348 - protein, 360 aa, Homo sapiens [sequence omitted]

SEQ ID NO: 52349 - protein, 360 aa, Homo sapiens [sequence omitted]

SEQ ID NO: 52350 - protein, 316 aa, Homo sapiens
  Payload ID: 10439
  Gene Symbol: MAPK1
  Gene Name: mitogen-activated protein kinase 1
  Uniprot ID: P28482
  ENSP ID: ENSP00000440842
MAAAAAAGAGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILALDLLDKMLTFNPHKRIEVEQALAHPYLEQYYDPSDEPIAEAPFKFDMELDDLPKEKLKELIFEETARFQPGYRS

SEQ ID NO: 52351 - protein, 245 aa, Homo sapiens
  Payload ID: 10440
  Gene Symbol: MAPK1IP1L
  Gene Name: mitogen-activated protein kinase 1 interacting protein 1-like
  Uniprot ID: Q8NDC0
  ENSP ID: ENSP00000378851
MSDEFSLADALPEHSPAKTSAVSNTKPGQPPQGWPGSNPWNNPSAPSSVPSGLPPSATPSTVPFGPAPTGMYPSVPPTGPPPGPPAPFPPSGPSCPPPGGPYPAPTVPGPGPTGPYPTPNMPFPELPRPYGAPTDPAAAGPLGPWGSMSSGPWAPGMGGQYPTPNMPYPSPGPYPAPPPPQAPGAAPPVPWGTVPPGAWGPPAPYPAPTGSYPTPGLYPTPSNPFQVPSGPSGAPPMPGGPHSYH

SEQ ID NO: 52352 - protein, 245 aa, Homo sapiens; identical to SEQ ID NO: 52351
  Payload ID: 10440
  Gene Symbol: MAPK1IP1L
  Gene Name: mitogen-activated protein kinase 1 interacting protein 1-like
  Uniprot ID: Q8NDC0
  ENSP ID: ENSP00000481882

SEQ ID NO: 52353 - protein, 143 aa, Homo sapiens
  Payload ID: 10441
  Gene Symbol: MAPK10
  Gene Name: mitogen-activated protein kinase 10
  ENSP ID: ENSP00000309857
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNLLSNGTDGCQLMSSDSDGIRP

SEQ ID NO: 52354 - protein, 464 aa, Homo sapiens
  Payload ID: 10441
  Gene Symbol: MAPK10
  Gene Name: mitogen-activated protein kinase 10
  Uniprot ID: P53779
  ENSP ID: ENSP00000352157
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 52355 - protein, 422 aa, Homo sapiens
  Payload ID: 10441
  Gene Symbol: MAPK10
  Gene Name: mitogen-activated protein kinase 10
  Uniprot ID: P53779
  ENSP ID: ENSP00000355297
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 52356 - protein, 319 aa, Homo sapiens
  Payload ID: 10441
  Gene Symbol: MAPK10
  Gene Name: mitogen-activated protein kinase 10
  ENSP ID: ENSP00000378586
MELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 52357 - protein, 277 aa, Homo sapiens
  Payload ID: 10441
  Gene Symbol: MAPK10
  Gene Name: mitogen-activated protein kinase 10
  Uniprot ID: P53779
  ENSP ID: ENSP00000378589
MELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 52358 - protein, 319 aa, Homo sapiens
  Payload ID: 10441
  Gene Symbol: MAPK10
  Gene Name: mitogen-activated protein kinase 10
  ENSP ID: ENSP00000378590
MELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDMWSVGCIMGEMIKGAVLFPGTDHIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 52359 - protein, 426 aa, Homo sapiens
  Payload ID: 10441
  Gene Symbol: MAPK10
  Gene Name: mitogen-activated protein kinase 10
  Uniprot ID: P53779
  ENSP ID: ENSP00000378595
MSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 52360 - protein, 426 aa, Homo sapiens; identical to SEQ ID NO: 52359
  Payload ID: 10441
  Gene Symbol: MAPK10
  Gene Name: mitogen-activated protein kinase 10
  Uniprot ID: P53779
  ENSP ID: ENSP00000378598

SEQ ID NO: 52361 - protein, 319 aa, Homo sapiens; identical to SEQ ID NO: 52358
  Payload ID: 10441
  Gene Symbol: MAPK10
  Gene Name: mitogen-activated protein kinase 10
  ENSP ID: ENSP00000414469

SEQ ID NO: 52362 - protein, 48 aa, Homo sapiens
  Payload ID: 10441
  Gene Symbol: MAPK10
  Gene Name: mitogen-activated protein kinase 10
  ENSP ID: ENSP00000420987
MSLHFLYYCSEPTLDVKIAFCQGFDKQVDVSYIAKHYNMSKSKVDNQF

SEQ ID NO: 52363 - protein, 91 aa, Homo sapiens
  Payload ID: 10441
  Gene Symbol: MAPK10
  Gene Name: mitogen-activated protein kinase 10
  ENSP ID: ENSP00000421359
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVA

SEQ ID NO: 52364 - protein, 50 aa, Homo sapiens
  Payload ID: 10441
  Gene Symbol: MAPK10
  Gene Name: mitogen-activated protein kinase 10
  ENSP ID: ENSP00000421409
MSLHFLYYCSEPTLDVKIAFCQGFDKQVDVSYIAKHYNMSKSKVDNQFYS

SEQ ID NO: 52365 - protein, 117 aa, Homo sapiens
  Payload ID: 10441
  Gene Symbol: MAPK10
  Gene Name: mitogen-activated protein kinase 10
  ENSP ID: ENSP00000421762
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKC

SEQ ID NO: 52366 - protein, 121 aa, Homo sapiens
  Payload ID: 10441
  Gene Symbol: MAPK10
  Gene Name: mitogen-activated protein kinase 10
  ENSP ID: ENSP00000422277
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHK

SEQ ID NO: 52367 - protein, 84 aa, Homo sapiens
  Payload ID: 10441
  Gene Symbol: MAPK10
  Gene Name: mitogen-activated protein kinase 10
  ENSP ID: ENSP00000422985
MSKSKVDNQFYSVEVGDSTFTVLKRYQNLKPIGSGAQGIVCAAYDAVLDRNVAIKKLSRPFQNQTHAKRAYRELVLMKCVNHKN

SEQ ID NO: 52368 - protein, 33 aa, Homo sapiens
  Payload ID: 10441
  Gene Symbol: MAPK10
  Gene Name: mitogen-activated protein kinase 10
  ENSP ID: ENSP00000423918
MSKSKVDNQFYSVEVGDSTFTVLKRYQNLKPIG

SEQ ID NO: 52369 - protein, 73 aa, Homo sapiens
  Payload ID: 10441
  Gene Symbol: MAPK10
  Gene Name: mitogen-activated protein kinase 10
  ENSP ID: ENSP00000424128
MSKSKVDNQFYSVEVGDSTFTVLKRYQNLKPIGSGAQGIVCAAYDAVLDRNVAIKKLSRPFQNQTHAKRAYRE

SEQ ID NO: 52370 - protein, 335 aa, Homo sapiens
  Payload ID: 10441
  Gene Symbol: MAPK10
  Gene Name: mitogen-activated protein kinase 10
  ENSP ID: ENSP00000424154
  MOD_RES (1)..(1): Any amino acid
XNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDMWSVGCIMGEMIKGAVLFPGTDHIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 52371 - protein, 141 aa, Homo sapiens
  Payload ID: 10441
  Gene Symbol: MAPK10
  Gene Name: mitogen-activated protein kinase 10
  ENSP ID: ENSP00000424755
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQD

SEQ ID NO: 52372 - protein, 51 aa, Homo sapiens
  Payload ID: 10441
  Gene Symbol: MAPK10
  Gene Name: mitogen-activated protein kinase 10
  ENSP ID: ENSP00000425654
MSKSKVDNQFYSVEVGDSTFTVLKRYQNLKPIGSGAQGIVCAAYDAVLDRN

SEQ ID NO: 52373 - protein, 364 aa, Homo sapiens
  Payload ID: 10442
  Gene Symbol: MAPK11
  Gene Name: mitogen-activated protein kinase 11
  Uniprot ID: Q15759
  ENSP ID: ENSP00000333685
MSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQALSDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHARTYIQSLPPMPQKDLSSIFRGANPLAIDLLGRMLVLDSDQRVSAAEALAHAYFSQYHDPEDEPEAEPYDESVEAKERTLEEWKELTYQEVLSFKPPEPPKPPGSLEIEQ

SEQ ID NO: 52374 - protein, 364 aa, Homo sapiens; identical to SEQ ID NO: 52373
  Payload ID: 10442
  Gene Symbol: MAPK11
  Gene Name: mitogen-activated protein kinase 11
  Uniprot ID: Q15759
  ENSP ID: ENSP00000379113

SEQ ID NO: 52375 - protein, 163 aa, Homo sapiens
  Payload ID: 10442
  Gene Symbol: MAPK11
  Gene Name: mitogen-activated protein kinase 11
  ENSP ID: ENSP00000409136
MSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQALSDEHVQFLVYQLLRGLKYIHSAGIIHRVGPEAQQRGCERGL

SEQ ID NO: 52376 - protein, 367 aa, Homo sapiens
  Payload ID: 10443
  Gene Symbol: MAPK12
  Gene Name: mitogen-activated protein kinase 12
  Uniprot ID: P53778
  ENSP ID: ENSP00000215659
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 52377 - protein, 119 aa, Homo sapiens
  Payload ID: 10443
  Gene Symbol: MAPK12
  Gene Name: mitogen-activated protein kinase 12
  ENSP ID: ENSP00000379124
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDLKVPCSGPWHQVCGR

SEQ ID NO: 52378 - protein, 277 aa, Homo sapiens
  Payload ID: 10443
  Gene Symbol: MAPK12
  Gene Name: mitogen-activated protein kinase 12
  ENSP ID: ENSP00000379126
MRHENVIGLLDVFTPDETLDDFTDFYLVMPFMGTDLGKLMKHEKLGEDRIQFLVYQMLKGLRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 52379 - protein, 357 aa, Homo sapiens
  Payload ID: 10443
  Gene Symbol: MAPK12
  Gene Name: mitogen-activated protein kinase 12
  Uniprot ID: P53778
  ENSP ID: ENSP00000479972
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 52380 - protein, 365 aa, Homo sapiens
  Payload ID: 10444
  Gene Symbol: MAPK13
  Gene Name: mitogen-activated protein kinase 13
  Uniprot ID: O15264
  ENSP ID: ENSP00000211287
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 52381 - protein, 152 aa, Homo sapiens
  Payload ID: 10444
  Gene Symbol: MAPK13
  Gene Name: mitogen-activated protein kinase 13
  ENSP ID: ENSP00000362864
MQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTGQILHPVPATDPQEGFHSAVPTGQPPG

SEQ ID NO: 52382 - protein, 257 aa, Homo sapiens
  Payload ID: 10444
  Gene Symbol: MAPK13
  Gene Name: mitogen-activated protein kinase 13
  Uniprot ID: O15264
  ENSP ID: ENSP00000362871
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTGQILHPVPATDPQEGFHSAVPTGQPPGCGPAGEDAGARRGQAPDGRAGPHPSLL

SEQ ID NO: 52383 - protein, 360 aa, Homo sapiens
  Payload ID: 10445
  Gene Symbol: MAPK14
  Gene Name: mitogen-activated protein kinase 14
  Uniprot ID: Q16539
  ENSP ID: ENSP00000229794
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 52384 - protein, 360 aa, Homo sapiens
  Payload ID: 10445
  Gene Symbol: MAPK14
  Gene Name: mitogen-activated protein kinase 14
  Uniprot ID: Q16539
  ENSP ID: ENSP00000229795
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHINQLQQIMRLTGTPPAYLINRMPSHEARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 52385 - protein, 307 aa, Homo sapiens
  Payload ID: 10445
  Gene Symbol: MAPK14
  Gene Name: mitogen-activated protein kinase 14
  Uniprot ID: Q16539
  ENSP ID: ENSP00000308669
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESLSTCWRRCLYWTQIRELQRPKPLHMPTLLSTTILMMNQWPILMISPLKAGTSL

SEQ ID NO: 52386 - protein, 90 aa, Homo sapiens
  Payload ID: 10445
  Gene Symbol: MAPK14
  Gene Name: mitogen-activated protein kinase 14
  ENSP ID: ENSP00000417065
  MOD_RES (1)..(1): Any amino acid
XKTIWEVPERYQNLSPVGSGAYGSVCAAFDTKTGLRVAVKKLSRPFQSIIHAKRTYRELRLLKHMKHENVIGLLDVFTPARSLEEFNDVA

SEQ ID NO: 52387 - protein, 173 aa, Homo sapiens
  Payload ID: 10445
  Gene Symbol: MAPK14
  Gene Name: mitogen-activated protein kinase 14
  ENSP ID: ENSP00000417531
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKFVCSSSAL

SEQ ID NO: 52388 - protein, 132 aa, Homo sapiens
  Payload ID: 10445
  Gene Symbol: MAPK14
  Gene Name: mitogen-activated protein kinase 14
  ENSP ID: ENSP00000419141
MKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSV

SEQ ID NO: 52389 - protein, 283 aa, Homo sapiens
  Payload ID: 10445
  Gene Symbol: MAPK14
  Gene Name: mitogen-activated protein kinase 14
  ENSP ID: ENSP00000419837
MKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 52390 - protein, 173 aa, Homo sapiens; identical to SEQ ID NO: 52387
  Payload ID: 10445
  Gene Symbol: MAPK14
  Gene Name: mitogen-activated protein kinase 14
  ENSP ID: ENSP00000478079

SEQ ID NO: 52391 - protein, 544 aa, Homo sapiens
  Payload ID: 10446
  Gene Symbol: MAPK15
  Gene Name: mitogen-activated protein kinase 15
  Uniprot ID: Q8TD08
  ENSP ID: ENSP00000337691
MCTVVDPRIVRRYLLRRQLGQGAYGIVWKAVDRRTGEVVAIKKIFDAFRDKTDAQRTFREITLLQEFGDHPNIISLLDVIRAENDRDIYLVFEFMDTDLNAVIRKGGLLQDVHVRSIFYQLLRATRFLHSGHVVHRDQKPSNVLLDANCTVKLCDFGLARSLGDLPEGPEDQAVTEYVATRWYRAPEVLLSSHRYTLGVDMWSLGCILGEMLRGRPLFPGTSTLHQLELILETIPPPSEEDLLALGSGCRASVLHQLGSRPRQTLDALLPPDTSPEALDLLRRLLVFAPDKRLSATQALQHPYVQRFHCPSDEWAREADVRPRAHEGVQLSVPEYRSRVYQMILECGGSSGTSREKGPEGVSPSQAHLHKPRADPQLPSRTPVQGPRPRPQSSPGHDPAEHESPRAAKNVPRQNSAPLLQTALLGNGERPPGAKEAPPLTLSLVKPSGRGAAPSLTSQAAAQVANQALIRGDWNRGGGVRVASVQQVPPRLPPEARPGRRMFSTSALQGAQGGARALLGGYSQAYGTVCHSALGHLPLLEGHHV

SEQ ID NO: 52392 - protein, 277 aa, Homo sapiens
  Payload ID: 10446
  Gene Symbol: MAPK15
  Gene Name: mitogen-activated protein kinase 15
  Uniprot ID: Q8TD08
  ENSP ID: ENSP00000378539
MCTVVDPRIVRRYLLRRQLGQGAYGIVWKAVDRRTGEVVAIKKIFDAFRDKTDAQRTFREITLLQEFGDHPNIISLLDVIRAENDRDIYLVFEFMGCPPSPPPPTAVRTLSADTDLNAVIRKGGLLQDVHVRSIFYQLLRATRFLHSGHVVHRDQKPSNVLLDANCTVKLCDFGLARSLGDLPEGPEDQAVTEYVATRWYRAPEVLLSSHRYTLGVDMWSLGCILGEMLRGRPLFPGTSTLHQLELILETIPPPSEEDLLALGSGCRASVLHQLGSR

SEQ ID NO: 52393 - protein, 254 aa, Homo sapiens
  Payload ID: 10446
  Gene Symbol: MAPK15
  Gene Name: mitogen-activated protein kinase 15
  Uniprot ID: Q8TD08
  ENSP ID: ENSP00000378540
MCTVVDPRIVRRYLLRRQLGQGAYGIVWKAVDRRTGEVVAIKKIFDAFRDKTDAQRTFREITLLQEFGDHPNIISLLDVIRAENDRDIYLVFEFMDTDLNAVIRKGGLLQDVHVRSIFYQLLRATRFLHSGHVVHRDQKPSNVLLDANCTVKLCDFGLARSLGDLPEGPEDQAVTEYVATRWYRAPEVLLSSHRYTLGVDMWSLGCILGEMLRGRPLFPGTSTLHQLELILETIPPPSEEGAQTACRSGTGAST

SEQ ID NO: 52394 - protein, 276 aa, Homo sapiens
  Payload ID: 10446
  Gene Symbol: MAPK15
  Gene Name: mitogen-activated protein kinase 15
  ENSP ID: ENSP00000478678
MCTVVDPRIVRRYLLRRQLGQGAYGIVWKAVDRRTGEVVAIKKIFDAFRDKTDAQRTFREITLLQEFGDHPNIISLLDVIRAENDRDIYLVFEFMGCPPSPPPPTAVRTLSADTDLNAVIRKGGLLQDVHVRSIFYQLLRATRFLHSGHVVHRDQKPSNVLLDANCTVKLCDFGLARSLGDLPEGPEDQAVTEYVATRWYRAPEVLLSSHRYTLGVDMWSLGCILGEMLRGRPLFPGTSTLHQLELILETIPPPSEEDLLALGSGCRASVLHQLGS

SEQ ID NO: 52395 - protein, 544 aa, Homo sapiens; identical to SEQ ID NO: 52391
  Payload ID: 10446
  Gene Symbol: MAPK15
  Gene Name: mitogen-activated protein kinase 15
  Uniprot ID: Q8TD08
  ENSP ID: ENSP00000483093

SEQ ID NO: 52396 - protein, 379 aa, Homo sapiens
  Payload ID: 10447
  Gene Symbol: MAPK3
  Gene Name: mitogen-activated protein kinase 3
  Uniprot ID: P27361
  ENSP ID: ENSP00000263025
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 52397 - protein, 335 aa, Homo sapiens
  Payload ID: 10447
  Gene Symbol: MAPK3
  Gene Name: mitogen-activated protein kinase 3
  Uniprot ID: P27361
  ENSP ID: ENSP00000327293
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILALDLLDRMLTFNPNKRITVEEALAHPYLEQYYDPTDEPVAEEPFTFAMELDDLPKERLKELIFQETARFQPGVLEAP

SEQ ID NO: 52398 - protein, 357 aa, Homo sapiens
  Payload ID: 10447
  Gene Symbol: MAPK3
  Gene Name: mitogen-activated protein kinase 3
  Uniprot ID: P27361
  ENSP ID: ENSP00000378625
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEVGQSPAAVGLGAGEQGGT

SEQ ID NO: 52399 - protein, 311 aa, Homo sapiens
  Payload ID: 10447
  Gene Symbol: MAPK3
  Gene Name: mitogen-activated protein kinase 3
  ENSP ID: ENSP00000378626
MVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 52400 - protein, 335 aa, Homo sapiens; identical to SEQ ID NO: 52397
  Payload ID: 10447
  Gene Symbol: MAPK3
  Gene Name: mitogen-activated protein kinase 3
  Uniprot ID: P27361
  ENSP ID: ENSP00000378628

SEQ ID NO: 52401 - protein, 136 aa, Homo sapiens
  Payload ID: 10447
  Gene Symbol: MAPK3
  Gene Name: mitogen-activated protein kinase 3
  ENSP ID: ENSP00000432292
MLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQP

SEQ ID NO: 52402 - protein, 339 aa, Homo sapiens
  Payload ID: 10447
  Gene Symbol: MAPK3
  Gene Name: mitogen-activated protein kinase 3
  ENSP ID: ENSP00000432479
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITWPRSPSPSPWSWMTYLRSG

SEQ ID NO: 52403 - protein, 265 aa, Homo sapiens
  Payload ID: 10447
  Gene Symbol: MAPK3
  Gene Name: mitogen-activated protein kinase 3
  ENSP ID: ENSP00000432742
MRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 52404 - protein, 87 aa, Homo sapiens
  Payload ID: 10447
  Gene Symbol: MAPK3
  Gene Name: mitogen-activated protein kinase 3
  ENSP ID: ENSP00000433639
MRDVYIVQDLMETDLYKLLKSQQLSNDHICYFLYQILRGLKYIHSANVLHRDLKPSNLLINTTCDLKICDFGLARIADPEHDHTGFL

SEQ ID NO: 52405 - protein, 316 aa, Homo sapiens
  Payload ID: 10447
  Gene Symbol: MAPK3
  Gene Name: mitogen-activated protein kinase 3
  ENSP ID: ENSP00000433746
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKGSRDMRPLTCWTGC

SEQ ID NO: 52406 - protein, 121 aa, Homo sapiens
  Payload ID: 10447
  Gene Symbol: MAPK3
  Gene Name: mitogen-activated protein kinase 3
  ENSP ID: ENSP00000436772
GILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 52407 - protein, 587 aa, Homo sapiens
  Payload ID: 10448
  Gene Symbol: MAPK4
  Gene Name: mitogen-activated protein kinase 4
  Uniprot ID: P31152
  ENSP ID: ENSP00000383234
MAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKGYLSEGLVTKWYRSPRLLLSPNNYTKAIDMWAAGCILAEMLTGRMLFAGAHELEQMQLILETIPVIREEDKDELLRVMPSFVSSTWEVKRPLRKLLPEVNSEAIDFLEKILTFNPMDRLTAEMGLQHPYMSPYSCPEDEPTSQHPFRIEDEIDDIVLMAANQSQLSNWDTCSSRYPVSLSSDLEWRPDRCQDASEVQRDPRAGSAPLAEDVQVDPRKDSHSSSERFLEQSHSSMERAFEADYGRSCDYKVGSPSYLDKLLWRDNKPHHYSEPKLILDLSHWKQAAGAPPTATGLADTGAREDEPASLFLEIAQWVKSTQGGPEHASPPADDPERRLSASPPGRPAPVDGGASPQFDLDVFISRALKLCTKPEDLPDNKLGDLNGACIPEHPGDLVQTEAFSKERW

SEQ ID NO: 52408 - protein, 376 aa, Homo sapiens
  Payload ID: 10448
  Gene Symbol: MAPK4
  Gene Name: mitogen-activated protein kinase 4
  ENSP ID: ENSP00000439231
MWAAGCILAEMLTGRMLFAGAHELEQMQLILETIPVIREEDKDELLRVMPSFVSSTWEVKRPLRKLLPEVNSEAIDFLEKILTFNPMDRLTAEMGLQHPYMSPYSCPEDEPTSQHPFRIEDEIDDIVLMAANQSQLSNWDTCSSRYPVSLSSDLEWRPDRCQDASEVQRDPRAGSAPLAEDVQVDPRKDSHSSSERFLEQSHSSMERAFEADYGRSCDYKVGSPSYLDKLLWRDNKPHHYSEPKLILDLSHWKQAAGAPPTATGLADTGAREDEPASLFLEIAQWVKSTQGGPEHASPPADDPERRLSASPPGRPAPVDGGASPQFDLDVFISRALKLCTKPEDLPDNKLGDLNGACIPEHPGDLVQTEAFSKERW

SEQ ID NO: 52409 - protein, 281 aa, Homo sapiens
  Payload ID: 10448
  Gene Symbol: MAPK4
  Gene Name: mitogen-activated protein kinase 4
  ENSP ID: ENSP00000465661
MAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKSTDCITSIVGHIPEPSEKGEVREVPFVLLSVLCKSNWGEFQSCGVGAAVKRLESEGTLGPGGLMEDSVMLDYVVSLPSLPLHPLLWSRDNDSSHPGRAS

SEQ ID NO: 52410 - protein, 233 aa, Homo sapiens
  Payload ID: 10448
  Gene Symbol: MAPK4
  Gene Name: mitogen-activated protein kinase 4
  ENSP ID: ENSP00000466233
MAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKGYLSEGLVTKWYRSPRLLLSPNNYTKAIDMWAAGCILAEMLTGRMLFAGTL

SEQ ID NO: 52411 - protein, 721 aa, Homo sapiens
  Payload ID: 10449
  Gene Symbol: MAPK6
  Gene Name: mitogen-activated protein kinase 6
  Uniprot ID: Q16659
  ENSP ID: ENSP00000261845
MAEKFESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILESIPVVHEEDRQELLSVIPVYIRNDMTEPHKPLTQLLPGISREALDFLEQILTFSPMDRLTAEEALSHPYMSIYSFPMDEPISSHPFHIEDEVDDILLMDETHSHIYNWERYHDCQFSEHDWPVHNNFDIDEVQLDPRALSDVTDEEEVQVDPRKYLDGDREKYLEDPAFDTNYSTEPCWQYSDHHENKYCDLECSHTCNYKTRSSSYLDNLVWRESEVNHYYEPKLIIDLSNWKEQSKEKSDKKGKSKCERNGLVKAQIALEEASQQLAGKEREKNQGFDFDSFIAGTIQLSSQHEPTDVVDKLNDLNSSVSQLELKSLISKSVSQEKQEKGMANLAQLEALYQSSWDSQFVSGGEDCFFINQFCEVRKDEQVEKENTYTSYLDKFFSRKEDTEMLETEPVEDGKLGERGHEEGFLNNSGEFLFNKQLESIGIPQFHSPVGSPLKSIQATLTPSAMKSSPQIPHQTYSSILKHLN

SEQ ID NO: 52412 - protein, 677 aa, Homo sapiens
  Payload ID: 10450
  Gene Symbol: MAPK7
  Gene Name: mitogen-activated protein kinase 7
  Uniprot ID: Q13164
  ENSP ID: ENSP00000299612
MESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 52413 - protein, 816 aa, Homo sapiens
  Payload ID: 10450
  Gene Symbol: MAPK7
  Gene Name: mitogen-activated protein kinase 7
  Uniprot ID: Q13164
  ENSP ID: ENSP00000311005
MAEPLKEEDGEDGSAEPPGPVKAEPAHTAASVAAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 52414 - protein, 816 aa, Homo sapiens; identical to SEQ ID NO: 52413
  Payload ID: 10450
  Gene Symbol: MAPK7
  Gene Name: mitogen-activated protein kinase 7
  Uniprot ID: Q13164
  ENSP ID: ENSP00000378966

SEQ ID NO: 52415 - protein, 816 aa, Homo sapiens; identical to SEQ ID NO: 52413
  Payload ID: 10450
  Gene Symbol: MAPK7
  Gene Name: mitogen-activated protein kinase 7
  Uniprot ID: Q13164
  ENSP ID: ENSP00000378968

SEQ ID NO: 52416 - protein, 241 aa, Homo sapiens
  Payload ID: 10450
  Gene Symbol: MAPK7
  Gene Name: mitogen-activated protein kinase 7
  ENSP ID: ENSP00000412902
MAEPLKEEDGEDGSAEPPGPVKAEPAHTAASVAAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQ

SEQ ID NO: 52417 - protein, 195 aa, Homo sapiens
  Payload ID: 10450
  Gene Symbol: MAPK7
  Gene Name: mitogen-activated protein kinase 7
  ENSP ID: ENSP00000458146
MESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSA

SEQ ID NO: 52418 - protein, 80 aa, Homo sapiens
  Payload ID: 10450
  Gene Symbol: MAPK7
  Gene Name: mitogen-activated protein kinase 7
  ENSP ID: ENSP00000462804
MAEPLKEEDGEDGSAEPPGPVKAEPAHTAASVAAKNLALLKARSFDVTFDVGDEYEIIETIGNGAYGVVSSARRRLTGEL

SEQ ID NO: 52419 - protein, 157 aa, Homo sapiens
  Payload ID: 10450
  Gene Symbol: MAPK7
  Gene Name: mitogen-activated protein kinase 7
  ENSP ID: ENSP00000462819
MAEPLKEEDGEDGSAEPPGPVKAEPAHTAASVAAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLE

SEQ ID NO: 52420 - protein, 144 aa, Homo sapiens
  Payload ID: 10450
  Gene Symbol: MAPK7
  Gene Name: mitogen-activated protein kinase 7
  ENSP ID: ENSP00000474397
MAEPLKEEDGEDGSAEPPGPVKAEPAHTAASVAAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVPYGVPGYVVLD

SEQ ID NO: 52421 - protein, 308 aa, Homo sapiens
  Payload ID: 10451
  Gene Symbol: MAPK8
  Gene Name: mitogen-activated protein kinase 8
  Uniprot ID: P45983
  ENSP ID: ENSP00000353483
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 52422 - protein, 218 aa, Homo sapiens [sequence omitted]

SEQ ID NO: 52423 - protein, 427 aa, Homo sapiens
  Payload ID: 10451
  Gene Symbol: MAPK8
  Gene Name: mitogen-activated protein kinase 8
  Uniprot ID: P45983
  ENSP ID: ENSP00000363291
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 52424 - protein, 384 aa, Homo sapiens
  Payload ID: 10451
  Gene Symbol: MAPK8
  Gene Name: mitogen-activated protein kinase 8
  Uniprot ID: P45983
  ENSP ID: ENSP00000363294
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 52425 - protein, 384 aa, Homo sapiens
  Payload ID: 10451
  Gene Symbol: MAPK8
  Gene Name: mitogen-activated protein kinase 8
  Uniprot ID: P45983
  ENSP ID: ENSP00000363297
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 52426 - protein, 427 aa, Homo sapiens
  Payload ID: 10451
  Gene Symbol: MAPK8
  Gene Name: mitogen-activated protein kinase 8
  Uniprot ID: P45983
  ENSP ID: ENSP00000363304
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 52427 - protein, 427 aa, Homo sapiens; identical to SEQ ID NO: 52423
  Payload ID: 10451
  Gene Symbol: MAPK8
  Gene Name: mitogen-activated protein kinase 8
  Uniprot ID: P45983
  ENSP ID: ENSP00000378974

SEQ ID NO: 52428 - protein, 142 aa, Homo sapiens
  Payload ID: 10451
  Gene Symbol: MAPK8
  Gene Name: mitogen-activated protein kinase 8
  ENSP ID: ENSP00000387936
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHL

SEQ ID NO: 52429 - protein, 97 aa, Homo sapiens
  Payload ID: 10451
  Gene Symbol: MAPK8
  Gene Name: mitogen-activated protein kinase 8
  ENSP ID: ENSP00000393223
MIIGLLNVFTPQKSLEEFQDVYIVMELMDANLCQVIQMELDHERMSYLLYQMLCGIKHLHSAGIIHRDLKPSNIVVKSDCTLKILDFGLARTAGTSF

SEQ ID NO: 52430 - protein, 142 aa, Homo sapiens; identical to SEQ ID NO: 52428
  Payload ID: 10451
  Gene Symbol: MAPK8
  Gene Name: mitogen-activated protein kinase 8
  ENSP ID: ENSP00000397729

SEQ ID NO: 52431 - protein, 711 aa, Homo sapiens
  Payload ID: 10452
  Gene Symbol: MAPK8IP1
  Gene Name: mitogen-activated protein kinase 8 interacting protein 1
  Uniprot ID: Q9UQF2
  ENSP ID: ENSP00000241014
MAERESGGLGGGAASPPAASPFLGLHIASPPNFRLTHDISLEEFEDEDLSEITDECGISLQCKDTLSLRPPRAGLLSAGGGGAGSRLQAEMLQMDLIDATGDTPGAEDDEEDDDEERAARRPGAGPPKAESGQEPASRGQGQSQGQSQGPGSGDTYRPKRPTTLNLFPQVPRSQDTLNNNSLGKKHSWQDRVSRSSSPLKTGEQTPPHEHICLSDELPPQSGPAPTTDRGTSTDSPCRRSTATQMAPPGGPPAAPPGGRGHSHRDRIHYQADVRLEATEEIYLTPVQRPPDAAEPTSAFLPPTESRMSVSSDPDPAAYPSTAGRPHPSISEEEEGFDCLSSPERAEPPGGGWRGSLGEPPPPPRASLSSDTSALSYDSVKYTLVVDEHAQLELVSLRPCFGDYSDESDSATVYDNCASVSSPYESAIGEEYEEAPRPQPPACLSEDSTPDEPDVHFSKKFLNVFMSGRSRSSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 52432 - protein, 701 aa, Homo sapiens
  Payload ID: 10452
  Gene Symbol: MAPK8IP1
  Gene Name: mitogen-activated protein kinase 8 interacting protein 1
  ENSP ID: ENSP00000378991
MQLVLKMDSSPDNDSWLEDQWERWLTHDISLEEFEDEDLSEITDECGISLQCKDTLSLRPPRAGLLSAGGGGAGSRLQAEMLQMDLIDATGDTPGAEDDEEDDDEERAARRPGAGPPKAESGQEPASRGQGQSQGQSQGPGSGDTYRPKRPTTLNLFPQVPRSQDTLNNNSLGKKHSWQDRVSRSSSPLKTGEQTPPHEHICLSDELPPQSGPAPTTDRGTSTDSPCRRSTATQMAPPGGPPAAPPGGRGHSHRDRIHYQADVRLEATEEIYLTPVQRPPDAAEPTSAFLPPTESRMSVSSDPDPAAYPSTAGRPHPSISEEEEGFDCLSSPERAEPPGGGWRGSLGEPPPPPRASLSSDTSALSYDSVKYTLVVDEHAQLELVSLRPCFGDYSDESDSATVYDNCASVSSPYESAIGEEYEEAPRPQPPACLSEDSTPDEPDVHFSKKFLNVFMSGRSRSSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 52433 - protein, 824 aa, Homo sapiens
  Payload ID: 10453
  Gene Symbol: MAPK8IP2
  Gene Name: mitogen-activated protein kinase 8 interacting protein 2
  Uniprot ID: Q13387
  ENSP ID: ENSP00000330572
MADRAEMFSLSTFHSLSPPGCRPPQDISLEEFDDEDLSEITDDCGLGLSYDSDHCEKDSLSLGRSEQPHPICSFQDDFQEFEMIDDNEEEDDEDEEEEEEEEEGDGEGQEGGDPGSEAPAPGPLIPSPSVEEPHKHRPTTLRLTTLGAQDSLNNNGGFDLVRPASWQETALCSPAPEALRELPGPLPATDTGPGGAQSPVRPGCDCEGNRPAEPPAPGGTSPSSDPGIEADLRSRSSGGRGGRRSSQELSSPGSDSEDAGGARLGRMISSISETELELSSDGGSSSSGRSSHLTNSIEEASSPASEPEPPREPPRRPAFLPVGPDDTNSEYESGSESEPDLSEDADSPWLLSNLVSRMISEGSSPIRCPGQCLSPAPRPPGEPVSPAGGAAQDSQDPEAAAGPGGVELVDMETLCAPPPPAPAAPRPGPAQPGPCLFLSNPTRDTITPLWAAPGRAARPGRACSAACSEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 52434 - protein, 1336 aa, Homo sapiens
  Payload ID: 10454
  Gene Symbol: MAPK8IP3
  Gene Name: mitogen-activated protein kinase 8 interacting protein 3
  Uniprot ID: Q9UPT6
  ENSP ID: ENSP00000250894
MMEIQMDEGGGVVVYQDDYCSGSVMSERVSGLAGSIYREFERLIHCYDEEVVKELMPLVVNVLENLDSVLSENQEHEVELELLREDNEQLLTQYEREKALRRQAEEKFIEFEDALEQEKKELQIQVEHYEFQTRQLELKAKNYADQISRLEERESEMKKEYNALHQRHTEMIQTYVEHIERSKMQQVGGNSQTESSLPGRRKERPTSLNVFPLADGTVRAQIGGKLVPAGDHWHLSDLGQLQSSSSYQCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSVRDDFFGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 52435 - protein, 1330 aa, Homo sapiens
  Payload ID: 10454
  Gene Symbol: MAPK8IP3
  Gene Name: mitogen-activated protein kinase 8 interacting protein 3
  ENSP ID: ENSP00000348290
MMEIQMDEGGGVVVYQDDYCSGSVMSERVSGLAGSIYREFERLIHCYDEEVVKELMPLVVNVLENLDSVLSENQEHEVELELLREDNEQLLTQYEREKALRRQAEEKFIEFEDALEQEKKELQIQVEHYEFQTRQLELKAKNYADQISRLEERESEMKKEYNALHQRHTEMIQTYVEHIERSKMQQVGGNSQTESSLPGRRKERPTSLNVFPLADGTVRAQIGGKLVPAGDHWHLSDLGQLQSSSSYQCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 52436 - protein, 69 aa, Homo sapiens
  Payload ID: 10454
  Gene Symbol: MAPK8IP3
  Gene Name: mitogen-activated protein kinase 8 interacting protein 3
  ENSP ID: ENSP00000454739
  MOD_RES (1)..(1): Any amino acid
XRPPHPAPQAPSPTRPHPPCPRPPSHPSTRACSPWGTMAWAPRTASVPGRSATAATWKYRSPRRCATSV

SEQ ID NO: 52437 - protein, 1337 aa, Homo sapiens
  Payload ID: 10454
  Gene Symbol: MAPK8IP3
  Gene Name: mitogen-activated protein kinase 8 interacting protein 3
  ENSP ID: ENSP00000481780
MMEIQMDEGGGVVVYQDDYCSGSVMSERVSGLAGSIYREFERLIHCYDEEVVKELMPLVVNVLENLDSVLSENQEHEVELELLREDNEQLLTQYEREKALRRQAEEKFIEFEDALEQEKKELQIQVEHYEFQTRQLELKAKNYADQISRLEERESEMKKEYNALHQRHTEMIQTYVEHIERSKMQQVGGNSQTESSLPGRSRKERPTSLNVFPLADGTVRAQIGGKLVPAGDHWHLSDLGQLQSSSSYQCPQDEMSESGQSSAAATPSTTGTKSNTPTSSVPSAAVTPLNESLQPLGDYGVGSKNSKRAREKRDSRNMEVQVTQEMRNVSIGMGSSDEWSDVQDIIDSTPELDMCPETRLDRTGSSPTQGIVNKAFGINTDSLYHELSTAGSEVIGDVDEGADLLGEFSVRDDFFGMGKEVGNLLLENSQLLETKNALNVVKNDLIAKVDQLSGEQEVLRGELEAAKQAKVKLENRIKELEEELKRVKSEAIIARREPKEEAEDVSSYLCTESDKIPMAQRRRFTRVEMARVLMERNQYKERLMELQEAVRWTEMIRASREHPSVQEKKKSTIWQFFSRLFSSSSSPPPAKRPYPSVNIHYKSPTTAGFSQRRNHAMCPISAGSRPLEFFPDDDCTSSARREQKREQYRQVREHVRNDDGRLQACGWSLPAKYKQLSPNGGQEDTRMKNVPVPVYCRPLVEKDPTMKLWCAAGVNLSGWRPNEDDAGNGVKPAPGRDPLTCDREGDGEPKSAHTSPEKKKAKELPEMDATSSRVWILTSTLTTSKVVIIDANQPGTVVDQFTVCNAHVLCISSIPAASDSDYPPGEMFLDSDVNPEDPGADGVLAGITLVGCATRCNVPRSNCSSRGDTPVLDKGQGEVATIANGKVNPSQSTEEATEATEVPDPGPSEPETATLRPGPLTEHVFTDPAPTPSSGPQPGSENGPEPDSSSTRPEPEPSGDPTGAGSSAAPTMWLGAQNGWLYVHSAVANWKKCLHSIKLKDSVLSLVHVKGRVLVALADGTLAIFHRGEDGQWDLSNYHLMDLGHPHHSIRCMAVVYDRVWCGYKNKVHVIQPKTMQIEKSFDAHPRRESQVRQLAWIGDGVWVSIRLDSTLRLYHAHTHQHLQDVDIEPYVSKMLGTGKLGFSFVRITALLVAGSRLWVGTGNGVVISIPLTETVVLHRGQLLGLRANKTSPTSGEGARPGGIIHVYGDDSSDRAASSFIPYCSMAQAQLCFHGHRDAVKFFVSVPGNVLATLNGSVLDSPAEGPGPAAPASEVEGQKLRNVLVLSGGEGYIDFRIGDGEDDETEEGAGDMSQVKPVLSKAERSHIIVWQVSYTPE

SEQ ID NO: 52438 - protein, 339 aa, Homo sapiens
  Payload ID: 10455
  Gene Symbol: MAPK9
  Gene Name: mitogen-activated protein kinase 9
  ENSP ID: ENSP00000321410
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENASQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 52439 - protein, 382 aa, Homo sapiens
  Payload ID: 10455
  Gene Symbol: MAPK9
  Gene Name: mitogen-activated protein kinase 9
  Uniprot ID: P45984
  ENSP ID: ENSP00000345524
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSAQMQQ

SEQ ID NO: 52440 - protein, 382 aa, Homo sapiens
  Payload ID: 10455
  Gene Symbol: MAPK9
  Gene Name: mitogen-activated protein kinase 9
  Uniprot ID: P45984
  ENSP ID: ENSP00000377028
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSAQMQQ

SEQ ID NO: 52441 - protein, 124 aa, Homo sapiens
  Payload ID: 10455
  Gene Symbol: MAPK9
  Gene Name: mitogen-activated protein kinase 9
  ENSP ID: ENSP00000377029
MSDSKCDSQFYSVQVADSTFTVLKRYQQLKPIGSGAQGIVWRHHCSALPFIGRMRPVSVIVTPWINQEGMLCEGLGWPSLPWCLTSTVCPAQNVRIVSLTLNVSLLHGKTVSRRSITGQLKCCI

SEQ ID NO: 52442 - protein, 124 aa, Homo sapiens; identical to SEQ ID NO: 52441
  Payload ID: 10455
  Gene Symbol: MAPK9
  Gene Name: mitogen-activated protein kinase 9
  ENSP ID: ENSP00000380262

SEQ ID NO: 52443 - protein, 424 aa, Homo sapiens
  Payload ID: 10455
  Gene Symbol: MAPK9
  Gene Name: mitogen-activated protein kinase 9
  Uniprot ID: P45984
  ENSP ID: ENSP00000389338
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 52444 - protein, 424 aa, Homo sapiens
  Payload ID: 10455
  Gene Symbol: MAPK9
  Gene Name: mitogen-activated protein kinase 9
  Uniprot ID: P45984
  ENSP ID: ENSP00000394560
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 52445 - protein, 242 aa, Homo sapiens
  Payload ID: 10455
  Gene Symbol: MAPK9
  Gene Name: mitogen-activated protein kinase 9
  Uniprot ID: P45984
  ENSP ID: ENSP00000397422
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDRILPRDLGPAMLS

SEQ ID NO: 52446 - protein, 103 aa, Homo sapiens
  Payload ID: 10455
  Gene Symbol: MAPK9
  Gene Name: mitogen-activated protein kinase 9
  ENSP ID: ENSP00000430608
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQD

SEQ ID NO: 52447 - protein, 214 aa, Homo sapiens
  Payload ID: 10455
  Gene Symbol: MAPK9
  Gene Name: mitogen-activated protein kinase 9
  ENSP ID: ENSP00000443149
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENAIKYWTLWH

SEQ ID NO: 52448 - protein, 522 aa, Homo sapiens
  Payload ID: 10456
  Gene Symbol: MAPKAP1
  Gene Name: mitogen-activated protein kinase associated protein 1
  Uniprot ID: Q9BPZ7
  ENSP ID: ENSP00000265960
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 52449 - protein, 486 aa, Homo sapiens
  Payload ID: 10456
  Gene Symbol: MAPKAP1
  Gene Name: mitogen-activated protein kinase associated protein 1
  Uniprot ID: Q9BPZ7
  ENSP ID: ENSP00000265961
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 52450 - protein, 132 aa, Homo sapiens
  Payload ID: 10456
  Gene Symbol: MAPKAP1
  Gene Name: mitogen-activated protein kinase associated protein 1
  ENSP ID: ENSP00000362595
MAFLDNPTIILAHIRQSHVTSDDTGMCEMVLIDHDVDLEKIHPPSMPGDSGSEIQGSNAQRLERLRKERQNQIKCKNIQWKERNSKQSAQELKSLFEKKSLKEKPPISGKQSILSVRLEQCPLQLNNPFNEY

SEQ ID NO: 52451 - protein, 522 aa, Homo sapiens; identical to SEQ ID NO: 52448
  Payload ID: 10456
  Gene Symbol: MAPKAP1
  Gene Name: mitogen-activated protein kinase associated protein 1
  Uniprot ID: Q9BPZ7
  ENSP ID: ENSP00000362597

SEQ ID NO: 52452 - protein, 330 aa, Homo sapiens
  Payload ID: 10456
  Gene Symbol: MAPKAP1
  Gene Name: mitogen-activated protein kinase associated protein 1
  Uniprot ID: Q9BPZ7
  ENSP ID: ENSP00000362602
MTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 52453 - protein, 475 aa, Homo sapiens
  Payload ID: 10456
  Gene Symbol: MAPKAP1
  Gene Name: mitogen-activated protein kinase associated protein 1
  Uniprot ID: Q9BPZ7
  ENSP ID: ENSP00000362610
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGPQYRLEKQSEPNVAVDLDSTLESQSAWEFCLVRENSISGDKVEIDPVTNQKASTKFWIKQKPISIDSDLLCACDLAEEKSPSHAIFKLTYLSNHDYKHLYFESDAATVNEIVLKVNYILESRASTARADYFAQKQRKLNRRTSFSFQKEKKSGQQ

SEQ ID NO: 52454 - protein, 323 aa, Homo sapiens
  Payload ID: 10456
  Gene Symbol: MAPKAP1
  Gene Name: mitogen-activated protein kinase associated protein 1
  Uniprot ID: Q9BPZ7
  ENSP ID: ENSP00000377624
MAFLDNPTIILAHIRQSHVTSDDTGMCEMVLIDHDVDLEKIHPPSMPGDSGSEIQGSNGETQGYVYAQSVDITSSWDFGIRRRSNTAQRLERLRKERQNQIKCKNIQWKERNSKQSAQELKSLFEKKSLKEKPPISGKQSILSVRLEQCPLQLNNPFNEYSKFDGKGHVGTTATKKIDVYLPLHSSQDRLLPMTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGACD

SEQ ID NO: 52455 - protein, 330 aa, Homo sapiens; identical to SEQ ID NO: 52452
  Payload ID: 10456
  Gene Symbol: MAPKAP1
  Gene Name: mitogen-activated protein kinase associated protein 1
  Uniprot ID: Q9BPZ7
  ENSP ID: ENSP00000377627

SEQ ID NO: 52456 - protein, 93 aa, Homo sapiens
  Payload ID: 10456
  Gene Symbol: MAPKAP1
  Gene Name: mitogen-activated protein kinase associated protein 1
  ENSP ID: ENSP00000390024
MAFLDNPTIILAHIRQSHVTSDDTGMCEMVLIDHDVDLEKIHPPSMPGDSGSEIQGSNGETQGYVYAQSVDITSSWDFGIRRRSNTAQRLERL

SEQ ID NO: 52457 - protein, 253 aa, Homo sapiens
  Payload ID: 10456
  Gene Symbol: MAPKAP1
  Gene Name: mitogen-activated protein kinase associated protein 1
  ENSP ID: ENSP00000400182
MTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGSRADGVFEEDSQIDIATVQDMLSSHHYKSFKVSMIHRLRFTTDVQLGISGDKVEIDPVTNQKASTKFWIKQKPISIDSDLLCACDLAEEKSPSHAIFKLTYLSNHDYKHLYFESDAATVNEIVLK

SEQ ID NO: 52458 - protein, 127 aa, Homo sapiens
  Payload ID: 10456
  Gene Symbol: MAPKAP1
  Gene Name: mitogen-activated protein kinase associated protein 1
  ENSP ID: ENSP00000408359
MTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVS

SEQ ID NO: 52459 - protein, 94 aa, Homo sapiens
  Payload ID: 10456
  Gene Symbol: MAPKAP1
  Gene Name: mitogen-activated protein kinase associated protein 1
  ENSP ID: ENSP00000412485
  MOD_RES (1)..(1): Any amino acid
XKSFKVSMIHRLRFTTDVQLGHAIFKLTYLSNHDYKHLYFESDAATVNEIVLKVNYILESRASTARADYFAQKQRKLNRRTSFSFQKEKKSGQQ

SEQ ID NO: 52460 - protein, 133 aa, Homo sapiens
  Payload ID: 10456
  Gene Symbol: MAPKAP1
  Gene Name: mitogen-activated protein kinase associated protein 1
  ENSP ID: ENSP00000417766
EQCPLQLNNPFNEYSKFDGKHCSSLCRIIMNKCFLQSLALNSSLQRKSLKTLQKSMKPPRNVANSEKGHVGTTATKKIDVYLPLHSSQDRLLPMTVVTMASARVQDLIGLICWQYTSEGREPKLNDNVSAYCL

SEQ ID NO: 52461 - protein, 245 aa, Homo sapiens
  Payload ID: 10456
  Gene Symbol: MAPKAP1
  Gene Name: mitogen-activated protein kinase associated protein 1
  ENSP ID: ENSP00000418607
MTVVTMASARVQDLIGLICWQYTSEGREPKLNDNVSAYCLHIAEDDGEVDTDFPPLDSNEPIHKFGFSTLALVEKYSSPGLTSKESLFVRINAAHGFSLIQVDNTKVTMKEILLKAVKRRKGSQKVSGSRADGVFEEDSQIDIATVQDMLSSHHYKSFKVSMIHRLRFTTDVQLGISGDKVEIDPVTNQKASTKFWIKQKPISIDSDLLCACDLAEEKSPRFRSSLLAESKRGLSAVAVHRASAQ

SEQ ID NO: 52462 - protein, 1514 aa, Homo sapiens
  Payload ID: 10457
  Gene Symbol: MAPKBP1
  Gene Name: mitogen-activated protein kinase binding protein 1
  Uniprot ID: O60336
  ENSP ID: ENSP00000393099
MAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQHDMIVNVWAWKKNIVVASNKVSSRVTAVSFSEDCSYFVTAGNRHIKFWYLDDSKTSKVNATVPLLGRSGLLGELRNNLFTDVACGRGKKADSTFCITSSGLLCEFSDRRLLDKWVELRNIDSFTTTVAHCISVSQDYIFCGCADGTVRLFNPSNLHFLSTLPRPHALGTDIASVTEASRLFSGVANARYPDTIALTFDPTNQWLSCVYNDHSIYVWDVRDPKKVGKVYSALYHSSCVWSVEVYPEVKDSNQACLPPSSFITCSSDNTIRLWNTESSGVHGSTLHRNILSSDLIKIIYVDGNTQALLDTELPGGDKADASLLDPRVGIRSVCVSPNGQHLASGDRMGTLRVHELQSLSEMLKVEAHDSEILCLEYSKPDTGLKLLASASRDRLIHVLDAGREYSLQQTLDEHSSSITAVKFAASDGQVRMISCGADKSIYFRTAQKSGDGVQFTRTHHVVRKTTLYDMDVEPSWKYTAIGCQDRNIRIFNISSGKQKKLFKGSQGEDGTLIKVQTDPSGIYIATSCSDKNLSIFDFSSGECVATMFGHSEIVTGMKFSNDCKHLISVSGDSCIFVWRLSSEMTISMRQRLAELRQRQRGGKQQGPSSPQRASGPNRHQAPSMLSPGPALSSDSDKEGEDEGTEEELPALPVLAKSTKKALASVPSPALPRSLSHWEMSRAQESVGFLDPAPAANPGPRRRGRWVQPGVELSVRSMLDLRQLETLAPSLQDPSQDSLAIIPSGPRKHGQEALETSLTSQNEKPPRPQASQPCSYPHIIRLLSQEEGVFAQDLEPAPIEDGIVYPEPSDNPTMDTSEFQVQAPARGTLGRVYPGSRSSEKHSPDSACSVDYSSSCLSSPEHPTEDSESTEPLSVDGISSDLEEPAEGDEEEEEEEGGMGPYGLQEGSPQTPDQEQFLKQHFETLASGAAPGAPVQVPERSESRSISSRFLLQVQTRPLREPSPSSSSLALMSRPAQVPQASGEQPRGNGANPPGAPPEVEPSSGNPSPQQAASVLLPRCRLNPDSSWAPKRVATASPFSGLQKAQSVHSLVPQERHEASLQAPSPGALLSREIEAQDGLGSLPPADGRPSRPHSYQNPTTSSMAKISRSISVGENLGLVAEPQAHAPIRVSPLSKLALPSRAHLVLDIPKPLPDRPTLAAFSPVTKGRAPGEAEKPGFPVGLGKAHSTTERWACLGEGTTPKPRTECQAHPGPSSPCAQQLPVSSLFQGPENLQPPPPEKTPNPMECTKPGAALSQDSEPAVSLEQCEQLVAELRGSVRQAVRLYHSVAGCKMPSAEQSRIAQLLRDTFSSVRQELEAVAGAVLSSPGSSPGAVGAEQTQALLEQYSELLLRAVERRMERKL

SEQ ID NO: 52463 - protein, 1508 aa, Homo sapiens
  Payload ID: 10457
  Gene Symbol: MAPKBP1
  Gene Name: mitogen-activated protein kinase binding protein 1
  Uniprot ID: O60336
  ENSP ID: ENSP00000397570
MAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQHDMIVNVWAWKKNIVVASNKVSSRVTAVSFSEDCSYFVTAGNRHIKFWYLDDSKTSKVNATVPLLGRSGLLGELRNNLFTDVACGRGKKADSTFCITSSGLLCEFSDRRLLDKWVELRTTVAHCISVSQDYIFCGCADGTVRLFNPSNLHFLSTLPRPHALGTDIASVTEASRLFSGVANARYPDTIALTFDPTNQWLSCVYNDHSIYVWDVRDPKKVGKVYSALYHSSCVWSVEVYPEVKDSNQACLPPSSFITCSSDNTIRLWNTESSGVHGSTLHRNILSSDLIKIIYVDGNTQALLDTELPGGDKADASLLDPRVGIRSVCVSPNGQHLASGDRMGTLRVHELQSLSEMLKVEAHDSEILCLEYSKPDTGLKLLASASRDRLIHVLDAGREYSLQQTLDEHSSSITAVKFAASDGQVRMISCGADKSIYFRTAQKSGDGVQFTRTHHVVRKTTLYDMDVEPSWKYTAIGCQDRNIRIFNISSGKQKKLFKGSQGEDGTLIKVQTDPSGIYIATSCSDKNLSIFDFSSGECVATMFGHSEIVTGMKFSNDCKHLISVSGDSCIFVWRLSSEMTISMRQRLAELRQRQRGGKQQGPSSPQRASGPNRHQAPSMLSPGPALSSDSDKEGEDEGTEEELPALPVLAKSTKKALASVPSPALPRSLSHWEMSRAQESVGFLDPAPAANPGPRRRGRWVQPGVELSVRSMLDLRQLETLAPSLQDPSQDSLAIIPSGPRKHGQEALETSLTSQNEKPPRPQASQPCSYPHIIRLLSQEEGVFAQDLEPAPIEDGIVYPEPSDNPTMDTSEFQVQAPARGTLGRVYPGSRSSEKHSPDSACSVDYSSSCLSSPEHPTEDSESTEPLSVDGISSDLEEPAEGDEEEEEEEGGMGPYGLQEGSPQTPDQEQFLKQHFETLASGAAPGAPVQVPERSESRSISSRFLLQVQTRPLREPSPSSSSLALMSRPAQVPQASGEQPRGNGANPPGAPPEVEPSSGNPSPQQAASVLLPRCRLNPDSSWAPKRVATASPFSGLQKAQSVHSLVPQERHEASLQAPSPGALLSREIEAQDGLGSLPPADGRPSRPHSYQNPTTSSMAKISRSISVGENLGLVAEPQAHAPIRVSPLSKLALPSRAHLVLDIPKPLPDRPTLAAFSPVTKGRAPGEAEKPGFPVGLGKAHSTTERWACLGEGTTPKPRTECQAHPGPSSPCAQQLPVSSLFQGPENLQPPPPEKTPNPMECTKPGAALSQDSEPAVSLEQCEQLVAELRGSVRQAVRLYHSVAGCKMPSAEQSRIAQLLRDTFSSVRQELEAVAGAVLSSPGSSPGAVGAEQTQALLEQYSELLLRAVERRMERKL

SEQ ID NO: 52464 - protein, 69 aa, Homo sapiens
  Payload ID: 10457
  Gene Symbol: MAPKBP1
  Gene Name: mitogen-activated protein kinase binding protein 1
  ENSP ID: ENSP00000421891
MAVEGSTITSRIKNLLRSPSIKLRRSKAGNRREDLSSKVCGCVVQSPETQTAPHPQQFQENHHCPCLLP

SEQ ID NO: 52465 - protein, 156 aa, Homo sapiens
  Payload ID: 10457
  Gene Symbol: MAPKBP1
  Gene Name: mitogen-activated protein kinase binding protein 1
  ENSP ID: ENSP00000422132
MAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQH

SEQ ID NO: 52466 - protein, 1231 aa, Homo sapiens
  Payload ID: 10457
  Gene Symbol: MAPKBP1
  Gene Name: mitogen-activated protein kinase binding protein 1
  Uniprot ID: O60336
  ENSP ID: ENSP00000426154
MAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQHDMIVNVWAWKKNIVVASNKVSSRVTAVSFSEDCSYFVTAGNRHIKFWYLDDSKTSKVNATVPLLGRSGLLGELRNNLFTDVACGRGKKADSTFCITSSGLLCEFSDRRLLDKWVELRTTVAHCISVSQDYIFCGCADGTVRLFNPSNLHFLSTLPRPHALGTDIASVTEASRLFSGVANARYPDTIALTFDPTNQWLSCVYNDHSIYVWDVRDPKKVGKVYSALYHSSCVWSVEVYPEVKDSNQACLPPSSFITCSSDNTIRLWNTESSGVHGSTLHRNILSSDLIKIIYVDGNTQALLDTELPGGDKADASLLDPRVGIRSVCVSPNGQHLASGDRMGTLRVHELQSLSEMLKVEAHDSEILCLEYSKPDTGLKLLASASRDRLIHVLDAGREYSLQQTLDEHSSSITAVKFAASDGQVRMISCGADKSIYFRTAQKSGDGVQFTRTHHVVRKTTLYDMDVEPSWKYTAIGCQDRNIRIFNISSGKQKKLFKGSQGEDGTLIKVQTDPSGIYIATSCSDKNLSIFDFSSGECVATMFGHSEIVTGMKFSNDCKHLISVSGDSCIFVWRLSSEMTISMRQRLAELRQRQRGGKQQGPSSPQRASGPNRHQAPSMLSPGPALSSDSDKEGEDEGTEEELPALPVLAKSTKKALASVPSPALPRSLSHWEMSRAQESVGFLDPAPAANPGPRRRGRWVQPGVELSVRSMLDLRQLETLAPSLQDPSQDSLAIIPSGPRKHGQEALETSLTSQNEKPPRPQASQPCSYPHIIRLLSQEEGVFAQDLEPAPIEDGIVYPEPSDNPTMDTSEFQVQAPARGTLGRVYPGSRSSEKHSPDSACSVDYSSSCLSSPEHPTEDSESTEPLSVDGISSDLEEPAEGDEEEEEEEGGMGPYGLQEGSPQTPDQEQFLKQHFETLASGAAPGAPVQVPERSESRSISSRFLLQVQTRPLREPSPSSSSLALMSRPAQVPQASEPAVSLEQCEQLVAELRGSVRQAVRLYHSVAGCKMPSAEQSRIAQLLRDTFSSVRQELEAVAGAVLSSPGSSPGAVGAEQTQALLEQYSELLLRAVERRMERKL

SEQ ID NO: 52467 - protein, 331 aa, Homo sapiens
  Payload ID: 10457
  Gene Symbol: MAPKBP1
  Gene Name: mitogen-activated protein kinase binding protein 1
  ENSP ID: ENSP00000427582
MAVEGSTITSRIKNLLRSPSIKLRRSKAGNRREDLSSKVTLEKVLGITVSGGRGLACDPRSGLVAYPAGCVVVLFNPRKHKQHHILNSSRKTITALAFSPDGKYLVTGESGHMPAVRVWDVAEHSQVAELQEHKYGVACVAFSPSAKYIVSVGYQHDMIVNVWAWKKNIVVASNKVSSRVTAVSFSEDCSYFVTAGNRHIKFWYLDDSKTSKVNATVPLLGRSGLLGELRNNLFTDVACGRGKKADSTFCITSSGLLCEFSDRRLLDKWVELRTTVAHCISVSQDYIFCGCADGTVRLFNPSNLHFLSTLPRPHALGTDIASVTEARSTPR

SEQ ID NO: 52468 - protein, 69 aa, Homo sapiens; identical to SEQ ID NO: 52464
  Payload ID: 10457
  Gene Symbol: MAPKBP1
  Gene Name: mitogen-activated protein kinase binding protein 1
  ENSP ID: ENSP00000487189

SEQ ID NO: 52469 - protein, 393 aa, Homo sapiens [sequence omitted]

SEQ ID NO: 52470 - protein, 217 aa, Homo sapiens
  Payload ID: 10458
  Gene Symbol: MAP2K1
  Gene Name: mitogen-activated protein kinase kinase 1
  ENSP ID: ENSP00000456438
MVPVHQQFLSKQHNVKPSNILVNSRGEIKLCDFGVSGQLIDSMANSFVGTRSYMSPERLQGTHYSVQSDIWSMGLSLVEMAVGRYPIPPPDAKELELMFGCQVEGDAAETPPRPRTPGRPLSSYGMDSRPPMAIFELLDYIVNEPPPKLPSGVFSLEFQDFVNKCLIKNPAERADLKQLMVHAFIKRSDAEEVDFAGWLCSTIGLNQPSTPTHAAGV

SEQ ID NO: 52471 - protein, 400 aa, Homo sapiens [sequence omitted]

SEQ ID NO: 52472 - protein, 303 aa, Homo sapiens
  Payload ID: 10459
  Gene Symbol: MAP2K2
  Gene Name: mitogen-activated protein kinase kinase 2
  ENSP ID: ENSP00000378336
MARKLIHLEIKPAIRNQIIRELQVLHECNSPYIVGFYGAFYSDGEISICMEHMDGGSLDQVLKEAKRIPEEILGKVSIAVLRGLAYLREKHQIMHRDVKPSNILVNSRGEIKLCDFGVSGQLIDSMANSFVGTRSYMAPERLQGTHYSVQSDIWSMGLSLVELAVGRYPIPPPDAKELEAIFGRPVVDGEEGEPHSISPRPRPPGRPVSGHGMDSRPAMAIFELLDYIVNEPPPKLPNGVFTPDFQEFVNKCLIKNPAERADLKMLTNHTFIKRSEVEEVDFAGWLCKTLRLNQPGTPTRTAV

SEQ ID NO: 52473 - protein, 104 aa, Homo sapiens
  Payload ID: 10459
  Gene Symbol: MAP2K2
  Gene Name: mitogen-activated protein kinase kinase 2
  ENSP ID: ENSP00000471763
  MOD_RES (1)..(1): Any amino acid
XLRGHALLHGCHGMDSRPAMAIFELLDYIVNEPPPKLPNGVFTPDFQEFVNKCLIKNPAERADLKMLTNHTFIKRSEVEEVDFAGWLCKTLRLNQPGTPTRTAV

SEQ ID NO: 52474 - protein, 318 aa, Homo sapiens
  Payload ID: 10460
  Gene Symbol: MAP2K3
  Gene Name: mitogen-activated protein kinase kinase 3
  Uniprot ID: P46734
  ENSP ID: ENSP00000319139
MSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHRDVKPSNVLINKEGHVKMCDFGISGYLVDSVAKTMDAGCKPYMAPERINPELNQKGYNVKSDVWSLGITMIEMAILRFPYESWGTPFQQLKQVVEEPSPQLPADRFSPEFVDFTAQCLRKNPAERMSYLELMEHPFFTLHKTKKTDIAAFVKEILGEDS

SEQ ID NO: 52475 - protein, 347 aa, Homo sapiens
  Payload ID: 10460
  Gene Symbol: MAP2K3
  Gene Name: mitogen-activated protein kinase kinase 3
  Uniprot ID: P46734
  ENSP ID: ENSP00000345083
MESPASSQPASMPQSKGKSKRKKDLRISCMSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHRDVKPSNVLINKEGHVKMCDFGISGYLVDSVAKTMDAGCKPYMAPERINPELNQKGYNVKSDVWSLGITMIEMAILRFPYESWGTPFQQLKQVVEEPSPQLPADRFSPEFVDFTAQCLRKNPAERMSYLELMEHPFFTLHKTKKTDIAAFVKEILGEDS

SEQ ID NO: 52476 - protein, 318 aa, Homo sapiens; identical to SEQ ID NO: 52474
  Payload ID: 10460
  Gene Symbol: MAP2K3
  Gene Name: mitogen-activated protein kinase kinase 3
  Uniprot ID: P46734
  ENSP ID: ENSP00000355081

SEQ ID NO: 52477 - protein, 46 aa, Homo sapiens
  Payload ID: 10460
  Gene Symbol: MAP2K3
  Gene Name: mitogen-activated protein kinase kinase 3
  ENSP ID: ENSP00000378869
MESPASSQPASMPQSKERLVISMVTIYGPQQVPICAVNPVLSTLQT

SEQ ID NO: 52478 - protein, 101 aa, Homo sapiens
  Payload ID: 10460
  Gene Symbol: MAP2K3
  Gene Name: mitogen-activated protein kinase kinase 3
  ENSP ID: ENSP00000431203
MESPASSQPASMPQSKGNSLSANPWPSAQREQSSQLARVRRRPGQRRLPAAGGCRGQSIYHPGLRGAWSPPIQPICASALDREAGHIHGDHLWATTGPHLR

SEQ ID NO: 52479 - protein, 160 aa, Homo sapiens
  Payload ID: 10460
  Gene Symbol: MAP2K3
  Gene Name: mitogen-activated protein kinase kinase 3
  ENSP ID: ENSP00000434068
MSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHR

SEQ ID NO: 52480 - protein, 136 aa, Homo sapiens
  Payload ID: 10460
  Gene Symbol: MAP2K3
  Gene Name: mitogen-activated protein kinase kinase 3
  ENSP ID: ENSP00000462178
IEMAILRFPYESWGTPFQQLKQVVEEPSPQLPADRFSPEFVDFTAQCLRKNPAERMSYLELMVSMGGRCLPCSSGLAGAGWGSGERAASCTQMGSSSGWPCVLSFRCSVICLLLHTWLPPPSFLHARPWEGYTGSV

SEQ ID NO: 52481 - protein, 46 aa, Homo sapiens
  Payload ID: 10460
  Gene Symbol: MAP2K3
  Gene Name: mitogen-activated protein kinase kinase 3
  ENSP ID: ENSP00000463202
MESPASSQPASMPQSKGRWMQRPVHIPPRPARSVVPTHPAHMCKCP

SEQ ID NO: 52482 - protein, 46 aa, Homo sapiens; identical to SEQ ID NO: 52481
  Payload ID: 10460
  Gene Symbol: MAP2K3
  Gene Name: mitogen-activated protein kinase kinase 3
  ENSP ID: ENSP00000463417

SEQ ID NO: 52483 - protein, 173 aa, Homo sapiens
  Payload ID: 10460
  Gene Symbol: MAP2K3
  Gene Name: mitogen-activated protein kinase kinase 3
  ENSP ID: ENSP00000464043
MESPASSQPASMPQSKGKSKRKKDLRISCMSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSM

SEQ ID NO: 52484 - protein, 318 aa, Homo sapiens; identical to SEQ ID NO: 52474
  Payload ID: 10460
  Gene Symbol: MAP2K3
  Gene Name: mitogen-activated protein kinase kinase 3
  Uniprot ID: P46734
  ENSP ID: ENSP00000478619

SEQ ID NO: 52485 - protein, 46 aa, Homo sapiens; identical to SEQ ID NO: 52481
  Payload ID: 10460
  Gene Symbol: MAP2K3
  Gene Name: mitogen-activated protein kinase kinase 3
  ENSP ID: ENSP00000486923

SEQ ID NO: 52486 - protein, 399 aa, Homo sapiens
  Payload ID: 10461
  Gene Symbol: MAP2K4
  Gene Name: mitogen-activated protein kinase kinase 4
  Uniprot ID: P45985
  ENSP ID: ENSP00000262445
MAAPSPSGGGGSGGGSGSGTPGPVGSPAPGHPAVSSMQGKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 52487 - protein, 410 aa, Homo sapiens
  Payload ID: 10461
  Gene Symbol: MAP2K4
  Gene Name: mitogen-activated protein kinase kinase 4
  Uniprot ID: P45985
  ENSP ID: ENSP00000410402
MAAPSPSGGGGSGGGSGSGTPGPVGSPAPGHPAVSSMQGFQINFCEKAQSKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 52488 - protein, 45 aa, Homo sapiens
  Payload ID: 10461
  Gene Symbol: MAP2K4
  Gene Name: mitogen-activated protein kinase kinase 4
  ENSP ID: ENSP00000463507
MAAPSPSGGGGSGGGSGSGTPGPVGSPAPGHPAVSSMQENSVNSG

SEQ ID NO: 52489 - protein, 16 aa, Homo sapiens
  Payload ID: 10461
  Gene Symbol: MAP2K4
  Gene Name: mitogen-activated protein kinase kinase 4
  ENSP ID: ENSP00000467239
  MOD_RES (1)..(1): Any amino acid
XHPAVSSMQENSVNSG

SEQ ID NO: 52490 - protein, 41 aa, Homo sapiens
  Payload ID: 10461
  Gene Symbol: MAP2K4
  Gene Name: mitogen-activated protein kinase kinase 4
  ENSP ID: ENSP00000473458
MAAPSPSGGGGSGGGSGSGTPGPVGSPAPGHPAVSSMQERD

SEQ ID NO: 52491 - protein, 92 aa, Homo sapiens
  Payload ID: 10461
  Gene Symbol: MAP2K4
  Gene Name: mitogen-activated protein kinase kinase 4
  ENSP ID: ENSP00000473472
MAAPSPSGGGGSGGGSGSGTPGPVGSPAPGHPAVSSMQGKRKALKLNFANPPFKSTARFTLNPNPTGVQNPHIEFGQQWMKKNKNNFLWIWM

SEQ ID NO: 52492 - protein, 41 aa, Homo sapiens; identical to SEQ ID NO: 52490
  Payload ID: 10461
  Gene Symbol: MAP2K4
  Gene Name: mitogen-activated protein kinase kinase 4
  ENSP ID: ENSP00000473511

SEQ ID NO: 52493 - protein, 41 aa, Homo sapiens; identical to SEQ ID NO: 52490
  Payload ID: 10461
  Gene Symbol: MAP2K4
  Gene Name: mitogen-activated protein kinase kinase 4
  ENSP ID: ENSP00000473582

SEQ ID NO: 52494 - protein, 45 aa, Homo sapiens; identical to SEQ ID NO: 52488
  Payload ID: 10461
  Gene Symbol: MAP2K4
  Gene Name: mitogen-activated protein kinase kinase 4
  ENSP ID: ENSP00000473606

SEQ ID NO: 52495 - protein, 448 aa, Homo sapiens
  Payload ID: 10462
  Gene Symbol: MAP2K5
  Gene Name: mitogen-activated protein kinase kinase 5
  Uniprot ID: Q13163
  ENSP ID: ENSP00000178640
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMELALGRFPYPQIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 52496 - protein, 258 aa, Homo sapiens
  Payload ID: 10462
  Gene Symbol: MAP2K5
  Gene Name: mitogen-activated protein kinase kinase 5
  ENSP ID: ENSP00000342101
MEDFEVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMELALGRFPYPQIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 52497 - protein, 412 aa, Homo sapiens
  Payload ID: 10462
  Gene Symbol: MAP2K5
  Gene Name: mitogen-activated protein kinase kinase 5
  Uniprot ID: Q13163
  ENSP ID: ENSP00000346493
MMEGHFPQSDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMELALGRFPYPQIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 52498 - protein, 438 aa, Homo sapiens
  Payload ID: 10462
  Gene Symbol: MAP2K5
  Gene Name: mitogen-activated protein kinase kinase 5
  Uniprot ID: Q13163
  ENSP ID: ENSP00000378859
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMEIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 52499 - protein, 128 aa, Homo sapiens
  Payload ID: 10462
  Gene Symbol: MAP2K5
  Gene Name: mitogen-activated protein kinase kinase 5
  ENSP ID: ENSP00000390196
DRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVK

SEQ ID NO: 52500 - protein, 182 aa, Homo sapiens
  Payload ID: 10462
  Gene Symbol: MAP2K5
  Gene Name: mitogen-activated protein kinase kinase 5
  ENSP ID: ENSP00000480580
  MOD_RES (1)..(1): Any amino acid
XCKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRANKDLCT

SEQ ID NO: 52501 - protein, 49 aa, Homo sapiens
  Payload ID: 10462
  Gene Symbol: MAP2K5
  Gene Name: mitogen-activated protein kinase kinase 5
  ENSP ID: ENSP00000483771
QYGIHSDVWSLGISFMEPLQLLQCIVDEDSPVLPVGEFSEPFVHFITQW

SEQ ID NO: 52502 - protein, 68 aa, Homo sapiens
  Payload ID: 10463
  Gene Symbol: MAP2K6
  Gene Name: mitogen-activated protein kinase kinase 6
  ENSP ID: ENSP00000351997
MSQSKGKKRNPGLKIPKEAFEQPQTSSTPPRDLDSKACISIGNQNFEVKADDLEPIMELGRADPSHSK

SEQ ID NO: 52503 - protein, 128 aa, Homo sapiens
  Payload ID: 10463
  Gene Symbol: MAP2K6
  Gene Name: mitogen-activated protein kinase kinase 6
  ENSP ID: ENSP00000464916
MSHRAWAEGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDV

SEQ ID NO: 52504 - protein, 84 aa, Homo sapiens
  Payload ID: 10463
  Gene Symbol: MAP2K6
  Gene Name: mitogen-activated protein kinase kinase 6
  ENSP ID: ENSP00000466143
MELGRGAYGVVEKMRHVPSGQIMAVKRIRATVNSQEQKRLLMDLDISMRTVDCPFTVTFYGALFREGDVWICMELMDTSLDKFY

SEQ ID NO: 52505 - protein, 278 aa, Homo sapiens
  Payload ID: 10463
  Gene Symbol: MAP2K6
  Gene Name: mitogen-activated protein kinase kinase 6
  Uniprot ID: P52564
  ENSP ID: ENSP00000467213
MELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 52506 - protein, 334 aa, Homo sapiens
  Payload ID: 10463
  Gene Symbol: MAP2K6
  Gene Name: mitogen-activated protein kinase kinase 6
  Uniprot ID: P52564
  ENSP ID: ENSP00000468348
MSQSKGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 52507 - protein, 278 aa, Homo sapiens; identical to SEQ ID NO: 52505
  Payload ID: 10463
  Gene Symbol: MAP2K6
  Gene Name: mitogen-activated protein kinase kinase 6
  Uniprot ID: P52564
  ENSP ID: ENSP00000477701

SEQ ID NO: 52508 - protein, 419 aa, Homo sapiens
  Payload ID: 10464
  Gene Symbol: MAP2K7
  Gene Name: mitogen-activated protein kinase kinase 7
  Uniprot ID: O14733
  ENSP ID: ENSP00000381066
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLVELATGQFPYKNCKTDFEVLTKVLQEEPPLLPGHMGFSGDFQSFVKDCLTKDHRKRPKYNKLLEHSFIKRYETLEVDVASWFKDVMAKTESPRTSGVLSQPHLPFFR

SEQ ID NO: 52509 - protein, 426 aa, Homo sapiens
  Payload ID: 10464
  Gene Symbol: MAP2K7
  Gene Name: mitogen-activated protein kinase kinase 7
  Uniprot ID: O14733
  ENSP ID: ENSP00000381068
MAASSLEQKLSRLEAKLKQENREARRRIDLNLDISPQRPRPTLQLPLANDGGSRSPSSESSPQHPTPPARPRHMLGLPSTLFTPRSMESIEIDQKLQEIMKQTGYLTIGGQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLPCPSPSQVELATGQFPYKNCKTDFEVLTKVLQEEPPLLPGHMGFSGDFQSFVKDCLTKDHRKRPKYNKLLEHSFIKRYETLEVDVASWFKDVMAKTESPRTSGVLSQPHLPFFR

SEQ ID NO: 52510 - protein, 435 aa, Homo sapiens
  Payload ID: 10464
  Gene Symbol: MAP2K7
  Gene Name: mitogen-activated protein kinase kinase 7
  Uniprot ID: O14733
  ENSP ID: ENSP00000381070
MAASSLEQKLSRLEAKLKQENREARRRIDLNLDISPQRPRPIIVITLSPAPAPSQRAALQLPLANDGGSRSPSSESSPQHPTPPARPRHMLGLPSTLFTPRSMESIEIDQKLQEIMKQTGYLTIGGQRYQAEINDLENLGEMGSGTCGQVWKMRFRKTGHVIAVKQMRRSGNKEENKRILMDLDVVLKSHDCPYIVQCFGTFITNTDVFIAMELMGTCAEKLKKRMQGPIPERILGKMTVAIVKALYYLKEKHGVIHRDVKPSNILLDERGQIKLCDFGISGRLVDSKAKTRSAGCAAYMAPERIDPPDPTKPDYDIRADVWSLGISLVELATGQFPYKNCKTDFEVLTKVLQEEPPLLPGHMGFSGDFQSFVKDCLTKDHRKRPKYNKLLEHSFIKRYETLEVDVASWFKDVMAKTESPRTSGVLSQPHLPFFR

SEQ ID NO: 52511 - protein, 1512 aa, Homo sapiens
  Payload ID: 10465
  Gene Symbol: MAP3K1
  Gene Name: mitogen-activated protein kinase kinase kinase 1, E3 ubiquitin protein ligase
  Uniprot ID: Q13233
  ENSP ID: ENSP00000382423
MAAAAGNRASSSGFPGARATSPEAGGGGGALKASSAPAAAAGLLREAGSGGRERADWRRRQLRKVRSVELDQLPEQPLFLAASPPASSTSPSPEPADAAGSGTGFQPVAVPPPHGAASRGGAHLTESVAAPDSGASSPAAAEPGEKRAPAAEPSPAAAPAGREMENKETLKGLHKMDDRPEERMIREKLKATCMPAWKHEWLERRNRRGPVVVKPIPVKGDGSEMNHLAAESPGEVQASAASPASKGRRSPSPGNSPSGRTVKSESPGVRRKRVSPVPFQSGRITPPRRAPSPDGFSPYSPEETNRRVNKVMRARLYLLQQIGPNSFLIGGDSPDNKYRVFIGPQNCSCARGTFCIHLLFVMLRVFQLEPSDPMLWRKTLKNFEVESLFQKYHSRRSSRIKAPSRNTIQKFVSRMSNSHTLSSSSTSTSSSENSIKDEEEQMCPICLLGMLDEESLTVCEDGCRNKLHHHCMSIWAEECRRNREPLICPLCRSKWRSHDFYSHELSSPVDSPSSLRAAQQQTVQQQPLAGSRRNQESNFNLTHYGTQQIPPAYKDLAEPWIQVFGMELVGCLFSRNWNVREMALRRLSHDVSGALLLANGESTGNSGGSSGSSPSGGATSGSSQTSISGDVVEACCSVLSMVCADPVYKVYVAALKTLRAMLVYTPCHSLAERIKLQRLLQPVVDTILVKCADANSRTSQLSISTLLELCKGQAGELAVGREILKAGSIGIGGVDYVLNCILGNQTESNNWQELLGRLCLIDRLLLEFPAEFYPHIVSTDVSQAEPVEIRYKKLLSLLTFALQSIDNSHSMVGKLSRRIYLSSARMVTTVPHVFSKLLEMLSVSSSTHFTRMRRRLMAIADEVEIAEAIQLGVEDTLDGQQDSFLQASVPNNYLETTENSSPECTVHLEKTGKGLCATKLSASSEDISERLASISVGPSSSTTTTTTTTEQPKPMVQTKGRPHSQCLNSSPLSHHSQLMFPALSTPSSSTPSVPAGTATDVSKHRLQGFIPCRIPSASPQTQRKFSLQFHRNCPENKDSDKLSPVFTQSRPLPSSNIHRPKPSRPTPGNTSKQGDPSKNSMTLDLNSSSKCDDSFGCSSNSSNAVIPSDETVFTPVEEKCRLDVNTELNSSIEDLLEASMPSSDTTVTFKSEVAVLSPEKAENDDTYKDDVNHNQKCKEKMEAEEEEALAIAMAMSASQDALPIVPQLQVENGEDIIIIQQDTPETLPGHTKAKQPYREDTEWLKGQQIGLGAFSSCYQAQDVGTGTLMAVKQVTYVRNTSSEQEEVVEALREEIRMMSHLNHPNIIRMLGATCEKSNYNLFIEWMAGGSVAHLLSKYGAFKESVVINYTEQLLRGLSYLHENQIIHRDVKGANLLIDSTGQRLRIADFGAAARLASKGTGAGEFQGQLLGTIAFMAPEVLRGQQYGRSCDVWSVGCAIIEMACAKPPWNAEKHSNHLALIFKIASATTAPSIPSHLSPGLRDVALRCLELQPQDRPPSRELLKHPVFRTTW

SEQ ID NO: 52512 - protein, 954 aa, Homo sapiens
  Payload ID: 10466
  Gene Symbol: MAP3K10
  Gene Name: mitogen-activated protein kinase kinase kinase 10
  Uniprot ID: Q02779
  ENSP ID: ENSP00000253055
MEEEEGAVAKEWGTTPAGPVWTAVFDYEAAGDEELTLRRGDRVQVLSQDCAVSGDEGWWTGQLPSGRVGVFPSNYVAPGAPAAPAGLQLPQEIPFHELQLEEIIGVGGFGKVYRALWRGEEVAVKAARLDPEKDPAVTAEQVCQEARLFGALQHPNIIALRGACLNPPHLCLVMEYARGGALSRVLAGRRVPPHVLVNWAVQVARGMNYLHNDAPVPIIHRDLKSINILILEAIENHNLADTVLKITDFGLAREWHKTTKMSAAGTYAWMAPEVIRLSLFSKSSDVWSFGVLLWELLTGEVPYREIDALAVAYGVAMNKLTLPIPSTCPEPFARLLEECWDPDPHGRPDFGSILKRLEVIEQSALFQMPLESFHSLQEDWKLEIQHMFDDLRTKEKELRSREEELLRAAQEQRFQEEQLRRREQELAEREMDIVERELHLLMCQLSQEKPRVRKRKGNFKRSRLLKLREGGSHISLPSGFEHKITVQASPTLDKRKGSDGASPPASPSIIPRLRAIRLTPVDCGGSSSGSSSGGSGTWSRGGPPKKEELVGGKKKGRTWGPSSTLQKERVGGEERLKGLGEGSKQWSSSAPNLGKSPKHTPIAPGFASLNEMEEFAEAEDGGSSVPPSPYSTPSYLSVPLPAEPSPGARAPWEPTPSAPPARWGHGARRRCDLALLGCATLLGAVGLGADVAEARAADGEEQRRWLDGLFFPRAGRFPRGLSPPARPHGRREDVGPGLGLAPSATLVSLSSVSDCNSTRSLLRSDSDEAAPAAPSPPPSPPAPTPTPSPSTNPLVDLELESFKKDPRQSLTPTHVTAACAVSRGHRRTPSDGALGQRGPPEPAGHGPGPRDLLDFPRLPDPQALFPARRRPPEFPGRPTTLTFAPRPRPAASRPRLDPWKLVSFGRTLTISPPSRPDTPESPGPPSVQPTLLDMDMEGQNQDSTVPLCGAHGSH

SEQ ID NO: 52513 - protein, 67 aa, Homo sapiens
  Payload ID: 10466
  Gene Symbol: MAP3K10
  Gene Name: mitogen-activated protein kinase kinase kinase 10
  ENSP ID: ENSP00000471116
  MOD_RES (1)..(1): Any amino acid
XNHNLADTVLKITDFGLAREWHKTTKMSAAGTYAWMAPEVIRLSLFSKSSDVWRMLGPRPPRAARFR

SEQ ID NO: 52514 - protein, 180 aa, Homo sapiens
  Payload ID: 10466
  Gene Symbol: MAP3K10
  Gene Name: mitogen-activated protein kinase kinase kinase 10
  ENSP ID: ENSP00000471916
LAREWHKTTKMSAAGTYAWMAPEVIRLSLFSKSSDVWSFGVLLWELLTGEVPYREIDALAVAYGVAMNKLTLPIPSTCPEPFARLLEECWDPDPHGRPDFGSILKRLEVIEQSALFQMPLESFHSLQEDWKLEIQHMFDDLRTKEKALSIRSQSRPLQLWISGKDPMGPAPLQAPASSPG

SEQ ID NO: 52515 - protein, 122 aa, Homo sapiens
  Payload ID: 10466
  Gene Symbol: MAP3K10
  Gene Name: mitogen-activated protein kinase kinase kinase 10
  ENSP ID: ENSP00000473021
QDHGLRPRPRVAQDHQDERCGDLRLDGAGECWDPDPHGRPDFGSILKRLEVIEQSALFQMPLESFHSLQEDWKLEIQHMFDDLRTKEKALSIRSQSRPLQLWISGKDPMGPAPLQAPASSPG

SEQ ID NO: 52516 - protein, 847 aa, Homo sapiens
  Payload ID: 10467
  Gene Symbol: MAP3K11
  Gene Name: mitogen-activated protein kinase kinase kinase 11
  Uniprot ID: Q16584
  ENSP ID: ENSP00000309597
MEPLKSLFLKSPLGSWNGSGSGGGGGGGGGRPEGSPKAAGYANPVWTALFDYEPSGQDELALRKGDRVEVLSRDAAISGDEGWWAGQVGGQVGIFPSNYVSRGGGPPPCEVASFQELRLEEVIGIGGFGKVYRGSWRGELVAVKAARQDPDEDISVTAESVRQEARLFAMLAHPNIIALKAVCLEEPNLCLVMEYAAGGPLSRALAGRRVPPHVLVNWAVQIARGMHYLHCEALVPVIHRDLKSNNILLLQPIESDDMEHKTLKITDFGLAREWHKTTQMSAAGTYAWMAPEVIKASTFSKGSDVWSFGVLLWELLTGEVPYRGIDCLAVAYGVAVNKLTLPIPSTCPEPFAQLMADCWAQDPHRRPDFASILQQLEALEAQVLREMPRDSFHSMQEGWKREIQGLFDELRAKEKELLSREEELTRAAREQRSQAEQLRRREHLLAQWELEVFERELTLLLQQVDRERPHVRRRRGTFKRSKLRARDGGERISMPLDFKHRITVQASPGLDRRRNVFEVGPGDSPTFPRFRAIQLEPAEPGQAWGRQSPRRLEDSSNGERRACWAWGPSSPKPGEAQNGRRRSRMDEATWYLDSDDSSPLGSPSTPPALNGNPPRPSLEPEEPKRPVPAERGSSSGTPKLIQRALLRGTALLASLGLGRDLQPPGGPGRERGESPTTPPTPTPAPCPTEPPPSPLICFSLKTPDSPPTPAPLLLDLGIPVGQRSAKSPRREEEPRGGTVSPPPGTSRSAPGTPGTPRSPPLGLISRPRPSPLRSRIDPWSFVSAGPRPSPLPSPQPAPRRAPWTLFPDSDPFWDSPPANPFQGGPQDCRAQTKDMGAQAPWVPEAGP

SEQ ID NO: 52517 - protein, 215 aa, Homo sapiens
  Payload ID: 10467
  Gene Symbol: MAP3K11
  Gene Name: mitogen-activated protein kinase kinase kinase 11
  ENSP ID: ENSP00000431506
DDMEHKTLKITDFGLAREWHKTTQMSAAGTYAWMAPEVIKASTFSKGSDVWSFGVLLWELLTGEVPYRGIDCLAVAYGVAVNKLTLPIPSTCPEPFAQLMAGRLEARDPGSLRRAASQGKGTTEPRGGADASGARAAVTGGAAAAARAPAGPVGARGVRARADAAAAAGGPRATARAPPPRDIQAQQAPGARRRRAYQHATRLQAPHHRAGLTRP

SEQ ID NO: 52518 - protein, 263 aa, Homo sapiens
  Payload ID: 10467
  Gene Symbol: MAP3K11
  Gene Name: mitogen-activated protein kinase kinase kinase 11
  ENSP ID: ENSP00000432068
MDEATWYLDSDDSSPLGSPSTPPALNGNPPRPSLEPEEPKRPVPAERGSSSGTPKLIQRALLRGTALLASLGLGRDLQPPGGPGRERGESPTTPPTPTPAPCPTEPPPSPLICFSLKTPDSPPTPAPLLLDLGIPVGQRSAKSPRREEEPRGGTVSPPPGTSRSAPGTPGTPRSPPLGLISRPRPSPLRSRIDPWSFVSAGPRPSPLPSPQPAPRRAPWTLFPDSDPFWDSPPANPFQGGPQDCRAQTKDMGAQAPWVPEAGP

SEQ ID NO: 52519 - protein, 590 aa, Homo sapiens
  Payload ID: 10467
  Gene Symbol: MAP3K11
  Gene Name: mitogen-activated protein kinase kinase kinase 11
  Uniprot ID: Q16584
  ENSP ID: ENSP00000433886
MEHKTLKITDFGLAREWHKTTQMSAAGTYAWMAPEVIKASTFSKGSDVWSFGVLLWELLTGEVPYRGIDCLAVAYGVAVNKLTLPIPSTCPEPFAQLMADCWAQDPHRRPDFASILQQLEALEAQVLREMPRDSFHSMQEGWKREIQGLFDELRAKEKELLSREEELTRAAREQRSQAEQLRRREHLLAQWELEVFERELTLLLQQVDRERPHVRRRRGTFKRSKLRARDGGERISMPLDFKHRITVQASPGLDRRRNVFEVGPGDSPTFPRFRAIQLEPAEPGQAWGRQSPRRLEDSSNGERRACWAWGPSSPKPGEAQNGRRRSRMDEATWYLDSDDSSPLGSPSTPPALNGNPPRPSLEPEEPKRPVPAERGSSSGTPKLIQRALLRGTALLASLGLGRDLQPPGGPGRERGESPTTPPTPTPAPCPTEPPPSPLICFSLKTPDSPPTPAPLLLDLGIPVGQRSAKSPRREEEPRGGTVSPPPGTSRSAPGTPGTPRSPPLGLISRPRPSPLRSRIDPWSFVSAGPRPSPLPSPQPAPRRAPWTLFPDSDPFWDSPPANPFQGGPQDCRAQTKDMGAQAPWVPEAGP

SEQ ID NO: 52520 - protein, 96 aa, Homo sapiens
  Payload ID: 10467
  Gene Symbol: MAP3K11
  Gene Name: mitogen-activated protein kinase kinase kinase 11
  ENSP ID: ENSP00000435237
MEHKTLKITDFGLAREWHKTTQMSAAGTYAWMAPEVIKASTFSKGSDVWSFGVLLWELLTGEVPYRGIDCLAVAYGVAVNKLTLPIPSTCPEPFAQ

SEQ ID NO: 52521 - protein, 111 aa, Homo sapiens
  Payload ID: 10467
  Gene Symbol: MAP3K11
  Gene Name: mitogen-activated protein kinase kinase kinase 11
  ENSP ID: ENSP00000435970
MPIESDDMEHKTLKITDFGLAREWHKTTQMSAAGTYAWMAPEVIKASTFSKGSDVWSFGVLLWELLTGEVPYRGIDCLAVAYGVAVNKLTLPIPSTCPEPFAQLMADCWAQ

SEQ ID NO: 52522 - protein, 859 aa, Homo sapiens
  Payload ID: 10468
  Gene Symbol: MAP3K12
  Gene Name: mitogen-activated protein kinase kinase kinase 12
  Uniprot ID: Q12852
  ENSP ID: ENSP00000267079
MACLHETRTPSPSFGGFVSTLSEASMRKLDPDTSDCTPEKDLTPTHVLQLHEQDAGGPGGAAGSPESRASRVRADEVRLQCQSGSGFLEGLFGCLRPVWTMIGKAYSTEHKQQQEDLWEVPFEEILDLQWVGSGAQGAVFLGRFHGEEVAVKKVRDLKETDIKHLRKLKHPNIITFKGVCTQAPCYCILMEFCAQGQLYEVLRAGRPVTPSLLVDWSMGIAGGMNYLHLHKIIHRDLKSPNMLITYDDVVKISDFGTSKELSDKSTKMSFAGTVAWMAPEVIRNEPVSEKVDIWSFGVVLWELLTGEIPYKDVDSSAIIWGVGSNSLHLPVPSSCPDGFKILLRQCWNSKPRNRPSFRQILLHLDIASADVLSTPQETYFKSQAEWREEVKLHFEKIKSEGTCLHRLEEELVMRRREELRHALDIREHYERKLERANNLYMELNALMLQLELKERELLRREQALERRCPGLLKPHPSRGLLHGNTMEKLIKKRNVPQKLSPHSKRPDILKTESLLPKLDAALSGVGLPGCPKGPPSPGRSRRGKTRHRKASAKGSCGDLPGLRTAVPPHEPGGPGSPGGLGGGPSAWEACPPALRGLHHDLLLRKMSSSSPDLLSAALGSRGRGATGGAGDPGSPPPARGDTPPSEGSAPGSTSPDSPGGAKGEPPPPVGPGEGVGLLGTGREGTSGRGGSRAGSQHLTPAALLYRAAVTRSQKRGISSEEEEGEVDSEVELTSSQRWPQSLNMRQSLSTFSSENPSDGEEGTASEPSPSGTPEVGSTNTDERPDERSDDMCSQGSEIPLDPPPSEVIPGPEPSSLPIPHQELLRERGPPNSEDSDCDSTELDNSNSVDALRPPASLPP

SEQ ID NO: 52523 - protein, 393 aa, Homo sapiens
  Payload ID: 10468
  Gene Symbol: MAP3K12
  Gene Name: mitogen-activated protein kinase kinase kinase 12
  ENSP ID: ENSP00000447889
MACLHETRTPSPSFGGFVSTLSEASMRKLDPDTSDCTPEKDLTPTHVLQLHEQDAGGPGGAAGSPESRASRVRADEVRLQCQSGSGFLEGLFGCLRPVWTMIGKAYSTEHKQQQEDLWEVPFEEILDLQWVGSGAQGAVFLGRFHGEEVAVKKVRDLKETDIKHLRKLKHPNIITFKGVCTQAPCYCILMEFCAQGQLYEVLRAGRPVTPSLLVDWSMGIAGGMNYLHLHKIIHRDLKSPNMLITYDDVVKISDFGTSKELSDKSTKMSFAGTVAWMAPEVIRNEPVSEKVDIWSFGVVLWELLTGEIPYKDVDSSAIIWGVGSNSLHLPVPSSCPDGFKILLRQCWNSKPRNRPSFRQILLHLDIASADVLSTPQETYFKSQVCCGQSGGKK

SEQ ID NO: 52524 - protein, 892 aa, Homo sapiens
  Payload ID: 10468
  Gene Symbol: MAP3K12
  Gene Name: mitogen-activated protein kinase kinase kinase 12
  Uniprot ID: Q12852
  ENSP ID: ENSP00000448689
MACLHETRTPSPSFGGFVSTLSEASMRKLDPDTSDCTPEKDLTPTQCVLRDVVPLGGQGGGGPSPSPGGEPPPEPFANSVLQLHEQDAGGPGGAAGSPESRASRVRADEVRLQCQSGSGFLEGLFGCLRPVWTMIGKAYSTEHKQQQEDLWEVPFEEILDLQWVGSGAQGAVFLGRFHGEEVAVKKVRDLKETDIKHLRKLKHPNIITFKGVCTQAPCYCILMEFCAQGQLYEVLRAGRPVTPSLLVDWSMGIAGGMNYLHLHKIIHRDLKSPNMLITYDDVVKISDFGTSKELSDKSTKMSFAGTVAWMAPEVIRNEPVSEKVDIWSFGVVLWELLTGEIPYKDVDSSAIIWGVGSNSLHLPVPSSCPDGFKILLRQCWNSKPRNRPSFRQILLHLDIASADVLSTPQETYFKSQAEWREEVKLHFEKIKSEGTCLHRLEEELVMRRREELRHALDIREHYERKLERANNLYMELNALMLQLELKERELLRREQALERRCPGLLKPHPSRGLLHGNTMEKLIKKRNVPQKLSPHSKRPDILKTESLLPKLDAALSGVGLPGCPKGPPSPGRSRRGKTRHRKASAKGSCGDLPGLRTAVPPHEPGGPGSPGGLGGGPSAWEACPPALRGLHHDLLLRKMSSSSPDLLSAALGSRGRGATGGAGDPGSPPPARGDTPPSEGSAPGSTSPDSPGGAKGEPPPPVGPGEGVGLLGTGREGTSGRGGSRAGSQHLTPAALLYRAAVTRSQKRGISSEEEEGEVDSEVELTSSQRWPQSLNMRQSLSTFSSENPSDGEEGTASEPSPSGTPEVGSTNTDERPDERSDDMCSQGSEIPLDPPPSEVIPGPEPSSLPIPHQELLRERGPPNSEDSDCDSTELDNSNSVDALRPPASLPP

SEQ ID NO: 52525 - protein, 892 aa, Homo sapiens; identical to SEQ ID NO: 52524
  Payload ID: 10468
  Gene Symbol: MAP3K12
  Gene Name: mitogen-activated protein kinase kinase kinase 12
  Uniprot ID: Q12852
  ENSP ID: ENSP00000449038

SEQ ID NO: 52526 - protein, 25 aa, Homo sapiens
  Payload ID: 10468
  Gene Symbol: MAP3K12
  Gene Name: mitogen-activated protein kinase kinase kinase 12
  ENSP ID: ENSP00000454355
MACLHETRTPSPSFGGFVSTLSEAS

SEQ ID NO: 52527 - protein, 966 aa, Homo sapiens
  Payload ID: 10469
  Gene Symbol: MAP3K13
  Gene Name: mitogen-activated protein kinase kinase kinase 13
  Uniprot ID: O43283
  ENSP ID: ENSP00000265026
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRSGSGSGGFLEGLFGCLRPVWNIIGKAYSTDYKLQQQDTWEVPFEEISELQWLGSGAQGAVFLGKFRAEEVAIKKVREQNETDIKHLRKLKHPNIIAFKGVCTQAPCYCIIMEYCAHGQLYEVLRAGRKITPRLLVDWSTGIASGMNYLHLHKIIHRDLKSPNVLVTHTDAVKISDFGTSKELSDKSTKMSFAGTVAWMAPEVIRNEPVSEKVDIWSFGVVLWELLTGEIPYKDVDSSAIIWGVGSNSLHLPVPSTCPDGFKILMKQTWQSKPRNRPSFRQTLMHLDIASADVLATPQETYFKSQAEWREEVKKHFEKIKSEGTCIHRLDEELIRRRREELRHALDIREHYERKLERANNLYMELSAIMLQLEMREKELIKREQAVEKKYPGTYKRHPVRPIIHPNAMEKLMKRKGVPHKSGMQTKRPDLLRSEGIPTTEVAPTASPLSGSPKMSTSSSKSRYRSKPRHRRGNSRGSHSDFAAILKNQPAQENSPHPTYLHQAQSQYPSLHHHNSLQQQYQQPPPAMSQSHHPRLNMHGQDIATCANNLRYFGPAAALRSPLSNHAQRQLPGSSPDLISTAMAADCWRSSEPDKGQAGPWGCCQADAYDPCLQCRPEQYGSLDIPSAEPVGRSPDLSKSPAHNPLLENAQSSEKTEENEFSGCRSESSLGTSHLGTPPALPRKTRPLQKSGDDSSEEEEGEVDSEVEFPRRQRPHRCISSCQSYSTFSSENFSVSDGEEGNTSDHSNSPDELADKLEDRLAEKLDDLLSQTPEIPIDISSHSDGLSDKECAVRRVKTQMSLGKLCVEERGYENPMQFEESDCDSSDGECSDATVRTNKHYSSATW

SEQ ID NO: 52528 - protein, 113 aa, Homo sapiens
  Payload ID: 10469
  Gene Symbol: MAP3K13
  Gene Name: mitogen-activated protein kinase kinase kinase 13
  ENSP ID: ENSP00000389495
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGT

SEQ ID NO: 52529 - protein, 128 aa, Homo sapiens
  Payload ID: 10469
  Gene Symbol: MAP3K13
  Gene Name: mitogen-activated protein kinase kinase kinase 13
  Uniprot ID: O43283
  ENSP ID: ENSP00000389798
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRYLGSAI

SEQ ID NO: 52530 - protein, 40 aa, Homo sapiens
  Payload ID: 10469
  Gene Symbol: MAP3K13
  Gene Name: mitogen-activated protein kinase kinase kinase 13
  ENSP ID: ENSP00000390323
MYCGIQILALWESIKYHVFEDHGLSSLCIQDLSLNNLIKT

SEQ ID NO: 52531 - protein, 40 aa, Homo sapiens; identical to SEQ ID NO: 52530
  Payload ID: 10469
  Gene Symbol: MAP3K13
  Gene Name: mitogen-activated protein kinase kinase kinase 13
  ENSP ID: ENSP00000392223

SEQ ID NO: 52532 - protein, 966 aa, Homo sapiens; identical to SEQ ID NO: 52527
  Payload ID: 10469
  Gene Symbol: MAP3K13
  Gene Name: mitogen-activated protein kinase kinase kinase 13
  Uniprot ID: O43283
  ENSP ID: ENSP00000399910

SEQ ID NO: 52533 - protein, 160 aa, Homo sapiens
  Payload ID: 10469
  Gene Symbol: MAP3K13
  Gene Name: mitogen-activated protein kinase kinase kinase 13
  Uniprot ID: O43283
  ENSP ID: ENSP00000403561
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRSGSGSGGFLEGLFGCLRPVWNIIGKAYSTDYKLQQQVF

SEQ ID NO: 52534 - protein, 137 aa, Homo sapiens
  Payload ID: 10469
  Gene Symbol: MAP3K13
  Gene Name: mitogen-activated protein kinase kinase kinase 13
  ENSP ID: ENSP00000405163
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRSGSGSGGFLEGLFGC

SEQ ID NO: 52535 - protein, 40 aa, Homo sapiens; identical to SEQ ID NO: 52530
  Payload ID: 10469
  Gene Symbol: MAP3K13
  Gene Name: mitogen-activated protein kinase kinase kinase 13
  ENSP ID: ENSP00000405233

SEQ ID NO: 52536 - protein, 194 aa, Homo sapiens
  Payload ID: 10469
  Gene Symbol: MAP3K13
  Gene Name: mitogen-activated protein kinase kinase kinase 13
  ENSP ID: ENSP00000407361
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRSGSGSGGFLEGLFGCLRPVWNIIGKAYSTDYKLQQQGVFVLRPHVIVLSWNTVPMDNSTRSYELAGRSHLDC

SEQ ID NO: 52537 - protein, 822 aa, Homo sapiens
  Payload ID: 10469
  Gene Symbol: MAP3K13
  Gene Name: mitogen-activated protein kinase kinase kinase 13
  Uniprot ID: O43283
  ENSP ID: ENSP00000409325
MSYVECKCLQLENKNTWEVPFEEISELQWLGSGAQGAVFLGKFRAEEVAIKKVREQNETDIKHLRKLKHPNIIAFKGVCTQAPCYCIIMEYCAHGQLYEVLRAGRKITPRLLVDWSTGIASGMNYLHLHKIIHRDLKSPNVLVTHTDAVKISDFGTSKELSDKSTKMSFAGTVAWMAPEVIRNEPVSEKVDIWSFGVVLWELLTGEIPYKDVDSSAIIWGVGSNSLHLPVPSTCPDGFKILMKQTWQSKPRNRPSFRQTLMHLDIASADVLATPQETYFKSQAEWREEVKKHFEKIKSEGTCIHRLDEELIRRRREELRHALDIREHYERKLERANNLYMELSAIMLQLEMREKELIKREQAVEKKYPGTYKRHPVRPIIHPNAMEKLMKRKGVPHKSGMQTKRPDLLRSEGIPTTEVAPTASPLSGSPKMSTSSSKSRYRSKPRHRRGNSRGSHSDFAAILKNQPAQENSPHPTYLHQAQSQYPSLHHHNSLQQQYQQPPPAMSQSHHPRLNMHGQDIATCANNLRYFGPAAALRSPLSNHAQRQLPGSSPDLISTAMAADCWRSSEPDKGQAGPWGCCQADAYDPCLQCRPEQYGSLDIPSAEPVGRSPDLSKSPAHNPLLENAQSSEKTEENEFSGCRSESSLGTSHLGTPPALPRKTRPLQKSGDDSSEEEEGEVDSEVEFPRRQRPHRCISSCQSYSTFSSENFSVSDGEEGNTSDHSNSPDELADKLEDRLAEKLDDLLSQTPEIPIDISSHSDGLSDKECAVRRVKTQMSLGKLCVEERGYENPMQFEESDCDSSDGECSDATVRTNKHYSSATW

SEQ ID NO: 52538 - protein, 759 aa, Homo sapiens
  Payload ID: 10469
  Gene Symbol: MAP3K13
  Gene Name: mitogen-activated protein kinase kinase kinase 13
  Uniprot ID: O43283
  ENSP ID: ENSP00000411483
MYCGIQILALWERGVCTQAPCYCIIMEYCAHGQLYEVLRAGRKITPRLLVDWSTGIASGMNYLHLHKIIHRDLKSPNVLVTHTDAVKISDFGTSKELSDKSTKMSFAGTVAWMAPEVIRNEPVSEKVDIWSFGVVLWELLTGEIPYKDVDSSAIIWGVGSNSLHLPVPSTCPDGFKILMKQTWQSKPRNRPSFRQTLMHLDIASADVLATPQETYFKSQAEWREEVKKHFEKIKSEGTCIHRLDEELIRRRREELRHALDIREHYERKLERANNLYMELSAIMLQLEMREKELIKREQAVEKKYPGTYKRHPVRPIIHPNAMEKLMKRKGVPHKSGMQTKRPDLLRSEGIPTTEVAPTASPLSGSPKMSTSSSKSRYRSKPRHRRGNSRGSHSDFAAILKNQPAQENSPHPTYLHQAQSQYPSLHHHNSLQQQYQQPPPAMSQSHHPRLNMHGQDIATCANNLRYFGPAAALRSPLSNHAQRQLPGSSPDLISTAMAADCWRSSEPDKGQAGPWGCCQADAYDPCLQCRPEQYGSLDIPSAEPVGRSPDLSKSPAHNPLLENAQSSEKTEENEFSGCRSESSLGTSHLGTPPALPRKTRPLQKSGDDSSEEEEGEVDSEVEFPRRQRPHRCISSCQSYSTFSSENFSVSDGEEGNTSDHSNSPDELADKLEDRLAEKLDDLLSQTPEIPIDISSHSDGLSDKECAVRRVKTQMSLGKLCVEERGYENPMQFEESDCDSSDGECSDATVRTNKHYSSATW

SEQ ID NO: 52539 - protein, 40 aa, Homo sapiens; identical to SEQ ID NO: 52530
  Payload ID: 10469
  Gene Symbol: MAP3K13
  Gene Name: mitogen-activated protein kinase kinase kinase 13
  ENSP ID: ENSP00000412037

SEQ ID NO: 52540 - protein, 246 aa, Homo sapiens
  Payload ID: 10469
  Gene Symbol: MAP3K13
  Gene Name: mitogen-activated protein kinase kinase kinase 13
  ENSP ID: ENSP00000415712
VAIKKVREQNETDIKHLRKLKHPNIIAFNVLVTHTDAVKISDFGTSKELSDKSTKMSFAGTVAWMAPEVIRNEPVSEKVDIWSFGVVLWELLTGEIPYKDVDSSAIIWGVGSNSLHLPVPSTCPDGFKILMKQTWQSKPRNRPSFRQTLMHLDIASADVLATPQETYFKSQAEWREEVKKHFEKIKSEGTCIHRLDEELIRRRREELRHALDIREHYERKLERANNLYMELSAIMLQLEMREKELI

SEQ ID NO: 52541 - protein, 947 aa, Homo sapiens
  Payload ID: 10470
  Gene Symbol: MAP3K14
  Gene Name: mitogen-activated protein kinase kinase kinase 14
  Uniprot ID: Q99558
  ENSP ID: ENSP00000478552
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 52542 - protein, 157 aa, Homo sapiens
  Payload ID: 10470
  Gene Symbol: MAP3K14
  Gene Name: mitogen-activated protein kinase kinase kinase 14
  ENSP ID: ENSP00000480974
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKPAWAT

SEQ ID NO: 52543 - protein, 947 aa, Homo sapiens; identical to SEQ ID NO: 52541
  Payload ID: 10470
  Gene Symbol: MAP3K14
  Gene Name: mitogen-activated protein kinase kinase kinase 14
  Uniprot ID: Q99558
  ENSP ID: ENSP00000482657

SEQ ID NO: 52544 - protein, 1313 aa, Homo sapiens
  Payload ID: 10471
  Gene Symbol: MAP3K15
  Gene Name: mitogen-activated protein kinase kinase kinase 15
  Uniprot ID: Q6ZN16
  ENSP ID: ENSP00000345629
MESGGGNAPAGALGAASESPQCPPPPGVEGAAGPAEPDGAAEGAAGGSGEGESGGGPRRALRAVYVRSESSQGGAAGGPEAGARQCLLRACEAEGAHLTSVPFGELDFGETAVLDAFYDADVAVVDMSDVSRQPSLFYHLGVRESFDMANNVILYHDTDADTALSLKDMVTQKNTASSGNYYFIPYIVTPCADYFCCESDAQRRASEYMQPNWDNILGPLCMPLVDRFISLLKDIHVTSCVYYKETLLNDIRKAREKYQGEELAKELARIKLRMDNTEVLTSDIIINLLLSYRDIQDYDAMVKLVETLEMLPTCDLADQHNIKFHYAFALNRRNSTGDREKALQIMLQVLQSCDHPGPDMFCLCGRIYKDIFLDSDCKDDTSRDSAIEWYRKGFELQSSLYSGINLAVLLIVAGQQFETSLELRKIGVRLNSLLGRKGSLEKMNNYWDVGQFFSVSMLAHDVGKAVQAAERLFKLKPPVWYLRSLVQNLLLIRRFKKTIIEHSPRQERLNFWLDIIFEATNEVTNGLRFPVLVIEPTKVYQPSYVSINNEAEERTVSLWHVSPTEMKQMHEWNFTASSIKGISLSKFDERCCFLYVHDNSDDFQIYFSTEEQCSRFFSLVKEMITNTAGSTVELEGETDGDTLEYEYDHDANGERVVLGKGTYGIVYAGRDLSNQVRIAIKEIPERDSRYSQPLHEEIALHKYLKHRNIVQYLGSVSENGYIKIFMEQVPGGSLSALLRSKWGPMKEPTIKFYTKQILEGLKYLHENQIVHRDIKGDNVLVNTYSGVVKISDFGTSKRLAGVNPCTETFTGTLQYMAPEIIDQGPRGYGAPADIWSLGCTIIEMATSKPPFHELGEPQAAMFKVGMFKIHPEIPEALSAEARAFILSCFEPDPHKRATTAELLREGFLRQVNKGKKNRIAFKPSEGPRGVVLALPTQGEPMATSSSEHGSVSPDSDAQPDALFERTRAPRHHLGHLLSVPDESSALEDRGLASSPEDRDQGLFLLRKDSERRAILYKILWEEQNQVASNLQECVAQSSEELHLSVGHIKQIIGILRDFIRSPEHRVMATTISKLKVDLDFDSSSISQIHLVLFGFQDAVNKILRNHLIRPHWMFAMDNIIRRAVQAAVTILIPELRAHFEPTCETEGVDKDMDEAEEGYPPATGPGQEAQPHQQHLSLQLGELRQETNRLLEHLVEKEREYQNLLRQTLEQKTQELYHLQLKLKSNCITENPAGPYGQRTDKELIDWLRLQGADAKTIEKIVEEGYTLSDILNEITKEDLRYLRLRGGLLCRLWSAVSQYRRAQEASETKDKA

SEQ ID NO: 52545 - protein, 283 aa, Homo sapiens
  Payload ID: 10471
  Gene Symbol: MAP3K15
  Gene Name: mitogen-activated protein kinase kinase kinase 15
  ENSP ID: ENSP00000352093
  MOD_RES (1)..(1): Any amino acid
XDIRKAREKYQGEELAKELARIKLRMDNTEVLTSDIIINLLLSYRDIQDYDAMVKLVETLEMLPTCDLADQHNIKFHYAFALNRRNSTGDREKALQIMLQVLQSCDHPGPDMFCLCGRIYKDIFLDSDCKDDTSRDSAIEWYRKGFELQSSLYSGINLAVLLIVAGQQFETSLELRKIGVRLNSLLGRKGSLEKMNNYWDVGQFFSVSMLAHDVGKAVQAAERLFKLKPPVWYLRSLVQNLLLIRRFKKTIIEHSPRQERLNFWLDIIFEATNEVTNGLRFPL

SEQ ID NO: 52546 - protein, 1215 aa, Homo sapiens
  Payload ID: 10472
  Gene Symbol: MAP3K19
  Gene Name: mitogen-activated protein kinase kinase kinase 19
  Uniprot ID: Q56UN5
  ENSP ID: ENSP00000351140
MSSMPKPERHAESLLDICHDTNSSPTDLMTVTKNQNIILQSISRSEEFDQDGDCSHSTLVNEEEDPSGGRQDWQPRTEEFSTSHMKYSGRSIKFLLPPLSLLPTRSGVLTIPQNHKFPKEKERNIPSLTSFVPKLSVSVRQSDELSPSNEPPGALVKSLMDPTLRSSDGFIWSRNMCSFPKTNHHRQCLEKEENWKSKEIEECNKIEITHFEKGQSLVSFENLKEGNIPAVREEDIDCHGSKTRKPEEENSQYLSSRKNESSVAKNYEQDPEIVCTIPSKFQETQHSEITPSQDEEMRNNKAASKRVSLHKNEAMEPNNILEECTVLKSLSSVVFDDPIDKLPEGCSSMETNIKISIAERAKPEMSRMVPLIHITFPVDGSPKEPVIAKPSLQTRKGTIHNNHSVNIPVHQENDKHKMNSHRSKLDSKTKTSKKTPQNFVISTEGPIKPTMHKTSIKTQIFPALGLVDPRPWQLPRFQKKMPQIAKKQSTHRTQKPKKQSFPCICKNPGTQKSCVPLSVQPTEPRLNYLDLKYSDMFKEINSTANGPGIYEMFGTPVYCHVRETERDENTYYREICSAPSGRRITNKCRSSHSERKSNIRTRLSQKKTHMKCPKTSFGIKQEHKVLISKEKSSKAVHSNLHDIENGDGISEPDWQIKSSGNEFLSSKDEIHPMNLAQTPEQSMKQNEFPPVSDLSIVEEVSMEESTGDRDISNNQILTTSLRDLQELEELHHQIPFIPSEDSWAVPSEKNSNKYVQQEKQNTASLSKVNASRILTNDLEFDSVSDHSKTLTNFSFQAKQESASSQTYQYWVHYLDHDSLANKSITYQMFGKTLSGTNSISQEIMDSVNNEELTDELLGCLAAELLALDEKDNNSCQKMANETDPENLNLVLRWRGSTPKEMGRETTKVKIQRHSSGLRIYDREEKFLISNEKKIFSENSLKSEEPILWTKGEILGKGAYGTVYCGLTSQGQLIAVKQVALDTSNKLAAEKEYRKLQEEVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTRDQHERPSALQLLKHSFLERSH

SEQ ID NO: 52547 - protein, 510 aa, Homo sapiens
  Payload ID: 10472
  Gene Symbol: MAP3K19
  Gene Name: mitogen-activated protein kinase kinase kinase 19
  Uniprot ID: Q56UN5
  ENSP ID: ENSP00000365004
MSSMPKPERHAESLLDICHDTNSSPTDLMTVTKNQNIILQSISRSEEFDQDGDCSHSTLVNEEEDPSGGRQDWQPRTEGVEITVTFPRDVSPPQEMSQEDLKEKNLINSSLQEWAQAHAVSHPNEIETVELRKKKLTMRPLVLQKEESSRELCNVNLGFLLPRSCLELNISKSVTREDAPHFLKEQQRKSEEFSTSHMKYSGRSIKRHSSGLRIYDREEKFLISNEKKIFSENSLKSEEPILWTKGEILGKGAYGTVYCGLTSQGQLIAVKQVALDTSNKLAAEKEYRKLQEEVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTRDQHERPSALQLLKHSFLERSH

SEQ ID NO: 52548 - protein, 1328 aa, Homo sapiens
  Payload ID: 10472
  Gene Symbol: MAP3K19
  Gene Name: mitogen-activated protein kinase kinase kinase 19
  Uniprot ID: Q56UN5
  ENSP ID: ENSP00000365005
MSSMPKPERHAESLLDICHDTNSSPTDLMTVTKNQNIILQSISRSEEFDQDGDCSHSTLVNEEEDPSGGRQDWQPRTEGVEITVTFPRDVSPPQEMSQEDLKEKNLINSSLQEWAQAHAVSHPNEIETVELRKKKLTMRPLVLQKEESSRELCNVNLGFLLPRSCLELNISKSVTREDAPHFLKEQQRKSEEFSTSHMKYSGRSIKFLLPPLSLLPTRSGVLTIPQNHKFPKEKERNIPSLTSFVPKLSVSVRQSDELSPSNEPPGALVKSLMDPTLRSSDGFIWSRNMCSFPKTNHHRQCLEKEENWKSKEIEECNKIEITHFEKGQSLVSFENLKEGNIPAVREEDIDCHGSKTRKPEEENSQYLSSRKNESSVAKNYEQDPEIVCTIPSKFQETQHSEITPSQDEEMRNNKAASKRVSLHKNEAMEPNNILEECTVLKSLSSVVFDDPIDKLPEGCSSMETNIKISIAERAKPEMSRMVPLIHITFPVDGSPKEPVIAKPSLQTRKGTIHNNHSVNIPVHQENDKHKMNSHRSKLDSKTKTSKKTPQNFVISTEGPIKPTMHKTSIKTQIFPALGLVDPRPWQLPRFQKKMPQIAKKQSTHRTQKPKKQSFPCICKNPGTQKSCVPLSVQPTEPRLNYLDLKYSDMFKEINSTANGPGIYEMFGTPVYCHVRETERDENTYYREICSAPSGRRITNKCRSSHSERKSNIRTRLSQKKTHMKCPKTSFGIKQEHKVLISKEKSSKAVHSNLHDIENGDGISEPDWQIKSSGNEFLSSKDEIHPMNLAQTPEQSMKQNEFPPVSDLSIVEEVSMEESTGDRDISNNQILTTSLRDLQELEELHHQIPFIPSEDSWAVPSEKNSNKYVQQEKQNTASLSKVNASRILTNDLEFDSVSDHSKTLTNFSFQAKQESASSQTYQYWVHYLDHDSLANKSITYQMFGKTLSGTNSISQEIMDSVNNEELTDELLGCLAAELLALDEKDNNSCQKMANETDPENLNLVLRWRGSTPKEMGRETTKVKIQRHSSGLRIYDREEKFLISNEKKIFSENSLKSEEPILWTKGEILGKGAYGTVYCGLTSQGQLIAVKQVALDTSNKLAAEKEYRKLQEEVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTRDQHERPSALQLLKHSFLERSH

SEQ ID NO: 52549 - protein, 1152 aa, Homo sapiens
  Payload ID: 10472
  Gene Symbol: MAP3K19
  Gene Name: mitogen-activated protein kinase kinase kinase 19
  ENSP ID: ENSP00000376647
MGAHWNFQVASFCRTGLVGKDRLKERHAESLLDICHDTNSSPTDLMTVTKNQNIILQSISRSEEFDQDGDCSHSTLVNEEEDPSGGRQDWQPRTEGVEITVTFPRDVSPPQEMSQEDLKEKNLINSSLQEWAQAHAVSHPNEIETVELRKKKLTMRPLVLQKEESSRELCNVNLGFLLPRSCLELNISKSVTREDAPHFLKEQQRKSEEFSTSHMKYSGRSIKFLLPPLSLLPTRSGVLTIPQNHKFPKEKERNIPSLTSFVPKLSVSVRQSDELSPSNEPPGALVKSLMDPTLRSSDGFIWSRNMCSFPKTNHHRQCLEKEENWKSKEIEECNKIEITHFEKGQSLVSFENLKEGNIPAVREEDIDCHGSKTRKPEEENSQYLSSRKNESSVAKNYEQDPEIVCTIPSKFQETQHSEITPSQDEEMRNNKAASKRVSLHKNEAMEPNNILEECTVLKSLSSVVFDDPIDKLPEGCSSMETNIKISIAERAKPEMSRMVPLIHITFPVDGSPKEPVIAKPSLQTRKGTIHNNHSVNIPVHQENDKHKMNSHRSKLDSKTKTSKKTPQNFVISTEGPIKPTMHKTSIKTQIFPALGLVDPRPWQLPRFQKKMPQIAKKQSTHRTQKPKKQSFPCICKNPGTQKSCVPLSVQPTEPRLNYLDLKYSDMFKEINSTANGPGIYEMFGTPVYCHVRETERDENTYYREICSAPSGRRITNKCRSSHSERKSNIRTRLSQKKTHMKCPKTSFGIKQEHKVLISKEKSSKAVHSNLHDIENGDGISEPDWQIKSSGNEFLSSKDEIHPMNLAQTPEQSMKQNEFPPVSDLSIVEEVSMEESTGDRDISNNQILTTSLRDLQELEELHHQIPFIPSEDSWAVPSEKNSNKYVQQEKQNTASLSKVNASRILTNDLEFDSVSDHSKTLTNFSFQAKQESASSQTYQYWVHYLDHDSLANKSITYQMFGKTLSGTNSISQEIMDSVNNEELTDELLGCLAAELLALDEKDNNSCQKMANETDPENLNLVLRWRGSTPKEMGRETTKVKIQRHSSGLRIYDREEKFLISNEKKIFSENSLKSEEPILWTKGEILGKGAYGTVQVQWERNIFLQQLNMLLEVWRIITRWQKQKMFLPFCELHKRSWGVGDEERYTVVSLVKDS

SEQ ID NO: 52550 - protein, 460 aa, Homo sapiens
  Payload ID: 10472
  Gene Symbol: MAP3K19
  Gene Name: mitogen-activated protein kinase kinase kinase 19
  Uniprot ID: Q56UN5
  ENSP ID: ENSP00000376649
MSSMPKPERHAESLLDICHDTNSSPTDLMTVTKNQNIILQSISRSEEFDQDGDCSHSTLVNEEEDPSGGRQDWQPRTEGVEITVTFPRDVSPPQEMSQEDLKEKNLINSSLQEWAQAHAVSHPNEIETVELRKKKLTMRPLVLQKEESSRELCNVNLGFLLPRSCLELNISKSVTREDAPHFLKEQQRKSEEFSTSHMKYSGRSIKVYCGLTSQGQLIAVKQVALDTSNKLAAEKEYRKLQEEVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTRDQHERPSALQLLKHSFLERSH

SEQ ID NO: 52551 - protein, 462 aa, Homo sapiens
  Payload ID: 10472
  Gene Symbol: MAP3K19
  Gene Name: mitogen-activated protein kinase kinase kinase 19
  Uniprot ID: Q56UN5
  ENSP ID: ENSP00000376650
MSSMPKPERHAESLLDICHDTNSSPTDLMTVTKNQNIILQSISRSEEFDQDGDCSHSTLVNEEEDPSGGRQDWQPRTEGVEITVTFPRDVSPPQEMSQEDLKEKNLINSSLQEWAQAHAVSHPNEIETVELRKKKLTMRPLVLQKEESSRELCNVNLGFLLPRSCLELNISKSVTREDAPHFLKEQQRKSEEFSTSHMKYSGRSIKRHSSGLRIYDREEKFLISNEKKIFSENSLKSEEPILWTKVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTRDQHERPSALQLLKHSFLERSH

SEQ ID NO: 52552 - protein, 102 aa, Homo sapiens
  Payload ID: 10472
  Gene Symbol: MAP3K19
  Gene Name: mitogen-activated protein kinase kinase kinase 19
  ENSP ID: ENSP00000390940
MTVTKNQNIILQSISRSEEFDQDGDCSHSTLVNEEEDPSGGRQDWQPRTEGVEITVTFPRDVSPPQEMSQEDLKEKNLINSSLQEWAQAHAVSHPNEIETVE

SEQ ID NO: 52553 - protein, 697 aa, Homo sapiens
  Payload ID: 10472
  Gene Symbol: MAP3K19
  Gene Name: mitogen-activated protein kinase kinase kinase 19
  ENSP ID: ENSP00000392827
KQSFPCICKNPGTQKSCVPLSVQPTEPRLNYLDLKYSDMFKEINSTANGPGIYEMFGTPVYCHVRETERDENTYYREICSAPSGRRITNKCRSSHSERKSNIRTRLSQKKTHMKCPKTSFGIKQEHKVLISKEKSSKAVHSNLHDIENGDGISEPDWQIKSSGNEFLSSKDEIHPMNLAQTPEQSMKQNEFPPVSDLSIVEEVSMEESTGDRDISNNQILTTSLRDLQELEELHHQIPFIPSEDSWAVPSEKNSNKYVQQEKQNTASLSKVNASRILTNDLEFDSVSDHSKTLTNFSFQAKQESASSQTYQYWVHYLDHDSLANKSITYQMFGKTLSGTNSISQEIMDSVNNEELTDELLGCLAAELLALDEKDNNSCQKMANETDPENLNLVLRWRGSTPKEMGRETTKVKIQRHSSGLRIYDREEKFLISNEKKIFSENSLKSEEPILWTKGEILGKGAYGTVYCGLTSQGQLIAVKQVALDTSNKLAAEKEYRKLQEEVDLLKALKHVNIVAYLGTCLQENTVSIFMEFVPGGSISSIINRFGPLPEMVFCKYTKQILQGVAYLHENCVVHRDIKGNNVMLMPTGIIKLIDFGCARRLAWAGLNGTHSDMLKSMHGTPYWMAPEVINESGYGRKSDIWSIGCTVFEMATGKPPLASMDRMAAMFYIGAHRGLMPPLPDHFSENAADFVRMCLTR

SEQ ID NO: 52554 - protein, 21 aa, Homo sapiens
  Payload ID: 10472
  Gene Symbol: MAP3K19
  Gene Name: mitogen-activated protein kinase kinase kinase 19
  ENSP ID: ENSP00000416345
MTVTKNQNIILQSISRSEEFD

SEQ ID NO: 52555 - protein, 619 aa, Homo sapiens
  Payload ID: 10473
  Gene Symbol: MAP3K2
  Gene Name: mitogen-activated protein kinase kinase kinase 2
  Uniprot ID: Q9Y2U5
  ENSP ID: ENSP00000343463
MDDQQALNSIMQDLAVLHKASRPALSLQETRKAKSSSPKKQNDVRVKFEHRGEKRILQFPRPVKLEDLRSKAKIAFGQSMDLHYTNNELVIPLTTQDDLDKAVELLDRSIHMKSLKILLVINGSTQATNLEPLPSLEDLDNTVFGAERKKRLSIIGPTSRDRSSPPPGYIPDELHQVARNGSFTSINSEGEFIPESMDQMLDPLSLSSPENSGSGSCPSLDSPLDGESYPKSRMPRAQSYPDNHQEFSDYDNPIFEKFGKGGTYPRRYHVSYHHQEYNDGRKTFPRARRTQGTSLRSPVSFSPTDHSLSTSSGSSIFTPEYDDSRIRRRGSDIDNPTLTVMDISPPSRSPRAPTNWRLGKLLGQGAFGRVYLCYDVDTGRELAVKQVQFDPDSPETSKEVNALECEIQLLKNLLHERIVQYYGCLRDPQEKTLSIFMEYMPGGSIKDQLKAYGALTENVTRKYTRQILEGVHYLHSNMIVHRDIKGANILRDSTGNVKLGDFGASKRLQTICLSGTGMKSVTGTPYWMSPEVISGEGYGRKADIWSVACTVVEMLTEKPPWAEFEAMAAIFKIATQPTNPKLPPHVSDYTRDFLKRIFVEAKLRPSADELLRHMFVHYH

SEQ ID NO: 52556 - protein, 47 aa, Homo sapiens
  Payload ID: 10473
  Gene Symbol: MAP3K2
  Gene Name: mitogen-activated protein kinase kinase kinase 2
  ENSP ID: ENSP00000386313
MDDQQALNSIMQDLAVLHKASRPALSLQETRKAKSSSPKKQNDVRVK

SEQ ID NO: 52557 - protein, 619 aa, Homo sapiens; identical to SEQ ID NO: 52555
  Payload ID: 10473
  Gene Symbol: MAP3K2
  Gene Name: mitogen-activated protein kinase kinase kinase 2
  Uniprot ID: Q9Y2U5
  ENSP ID: ENSP00000387246

SEQ ID NO: 52558 - protein, 626 aa, Homo sapiens
  Payload ID: 10474
  Gene Symbol: MAP3K3
  Gene Name: mitogen-activated protein kinase kinase kinase 3
  Uniprot ID: Q99759
  ENSP ID: ENSP00000354485
MDEQEALNSIMNDLVALQMNRRHRMPGYETMKNKDTGHSNRQSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 52559 - protein, 657 aa, Homo sapiens
  Payload ID: 10474
  Gene Symbol: MAP3K3
  Gene Name: mitogen-activated protein kinase kinase kinase 3
  Uniprot ID: Q99759
  ENSP ID: ENSP00000354927
MDEQEALNSIMNDLVALQMNRRHRMPGYETMKNKDTGHSNRQKKHNSSSSALLNSPTVTTSSCAGASEKKKFLSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 52560 - protein, 657 aa, Homo sapiens; identical to SEQ ID NO: 52559
  Payload ID: 10474
  Gene Symbol: MAP3K3
  Gene Name: mitogen-activated protein kinase kinase kinase 3
  Uniprot ID: Q99759
  ENSP ID: ENSP00000461988

SEQ ID NO: 52561 - protein, 622 aa, Homo sapiens
  Payload ID: 10474
  Gene Symbol: MAP3K3
  Gene Name: mitogen-activated protein kinase kinase kinase 3
  ENSP ID: ENSP00000462086
MDEQEALNSIMNDLVALQMNRRHRMPGYETMKNKDTGHSNRQSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 52562 - protein, 56 aa, Homo sapiens
  Payload ID: 10474
  Gene Symbol: MAP3K3
  Gene Name: mitogen-activated protein kinase kinase kinase 3
  ENSP ID: ENSP00000462917
MDEQEALNSIMNDLVALQMNRRHRMPGYETMKNKDTGHSNRVTSESSSSTTGRGEL

SEQ ID NO: 52563 - protein, 653 aa, Homo sapiens
  Payload ID: 10474
  Gene Symbol: MAP3K3
  Gene Name: mitogen-activated protein kinase kinase kinase 3
  ENSP ID: ENSP00000464130
MDEQEALNSIMNDLVALQMNRRHRMPGYETMKNKDTGHSNRQKKHNSSSSALLNSPTVTTSSCAGASEKKKFLSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 52564 - protein, 42 aa, Homo sapiens
  Payload ID: 10474
  Gene Symbol: MAP3K3
  Gene Name: mitogen-activated protein kinase kinase kinase 3
  ENSP ID: ENSP00000464482
  MOD_RES (1)..(1): Any amino acid
XLCYDVDTGRELASKQVQFDPDSPETSKFPRQIPVRPLTRAS

SEQ ID NO: 52565 - protein, 31 aa, Homo sapiens
  Payload ID: 10474
  Gene Symbol: MAP3K3
  Gene Name: mitogen-activated protein kinase kinase kinase 3
  ENSP ID: ENSP00000464532
  MOD_RES (1)..(1): Any amino acid
XASQSAGDINTIYQPPEPRSRHLSVSRIASN

SEQ ID NO: 52566 - protein, 1554 aa, Homo sapiens
  Payload ID: 10475
  Gene Symbol: MAP3K4
  Gene Name: mitogen-activated protein kinase kinase kinase 4
  ENSP ID: ENSP00000297332
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDRKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTAIHRNSPRPMKVPRCHSDPPNPHLIIPTPEGFRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 52567 - protein, 1558 aa, Homo sapiens
  Payload ID: 10475
  Gene Symbol: MAP3K4
  Gene Name: mitogen-activated protein kinase kinase kinase 4
  Uniprot ID: Q9Y6R4
  ENSP ID: ENSP00000355886
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDRKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 52568 - protein, 1604 aa, Homo sapiens
  Payload ID: 10475
  Gene Symbol: MAP3K4
  Gene Name: mitogen-activated protein kinase kinase kinase 4
  ENSP ID: ENSP00000355887
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDRKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTAIHRNSPRPMKVPRCHSDPPNPHLIIPTPEGFSTRSMPSDARSHGSPAAAAAAAAAAVAASRPSPSGGDSVLPKSISSAHDTRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 52569 - protein, 1608 aa, Homo sapiens
  Payload ID: 10475
  Gene Symbol: MAP3K4
  Gene Name: mitogen-activated protein kinase kinase kinase 4
  Uniprot ID: Q9Y6R4
  ENSP ID: ENSP00000375986
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDRKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFSTRSMPSDARSHGSPAAAAAAAAAAVAASRPSPSGGDSVLPKSISSAHDTRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 52570 - protein, 23 aa, Homo sapiens
  Payload ID: 10475
  Gene Symbol: MAP3K4
  Gene Name: mitogen-activated protein kinase kinase kinase 4
  ENSP ID: ENSP00000390508
MKRMSTKHQRNNVGRPASRSNLK

SEQ ID NO: 52571 - protein, 85 aa, Homo sapiens
  Payload ID: 10475
  Gene Symbol: MAP3K4
  Gene Name: mitogen-activated protein kinase kinase kinase 4
  ENSP ID: ENSP00000439377
MREAAAALVPPPAFAVTPAAAMEEPPPPPPPPPPPPEPETESEPECCLAASFLNFQIPCGVQIMCSCQGHHLHLRRNAVLCRGRS

SEQ ID NO: 52572 - protein, 1442 aa, Homo sapiens
  Payload ID: 10475
  Gene Symbol: MAP3K4
  Gene Name: mitogen-activated protein kinase kinase kinase 4
  ENSP ID: ENSP00000445018
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDRKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFSTRSMPSDARSHGSPAAAAAAAAAAVAASRPSPSGGDSVLPKSISSAHDTRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHRSTVTLPNSQEISMSYIISAFSLKLEEFLLK

SEQ ID NO: 52573 - protein, 636 aa, Homo sapiens
  Payload ID: 10475
  Gene Symbol: MAP3K4
  Gene Name: mitogen-activated protein kinase kinase kinase 4
  ENSP ID: ENSP00000446303
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDRKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEGDMRHQSIYVRCTLVPSRKTGQLEAGMGLAGHSFLNFQIPCGVQIMCSCQGHHLHLRRNAVLCRGRS

SEQ ID NO: 52574 - protein, 1374 aa, Homo sapiens
  Payload ID: 10476
  Gene Symbol: MAP3K5
  Gene Name: mitogen-activated protein kinase kinase kinase 5
  Uniprot ID: Q99683
  ENSP ID: ENSP00000351908
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 52575 - protein, 1288 aa, Homo sapiens
  Payload ID: 10477
  Gene Symbol: MAP3K6
  Gene Name: mitogen-activated protein kinase kinase kinase 6
  Uniprot ID: O95382
  ENSP ID: ENSP00000350195
MAGPCPRSGAERAGSCWQDPLAVALSRGRQLAAPPGRGCARSRPLSVVYVLTREPQPGLEPREGTEAEPLPLRCLREACAQVPRPRPPPQLRSLPFGTLELGDTAALDAFYNADVVVLEVSSSLVQPSLFYHLGVRESFSMTNNVLLCSQADLPDLQALREDVFQKNSDCVGSYTLIPYVVTATGRVLCGDAGLLRGLADGLVQAGVGTEALLTPLVGRLARLLEATPTDSCGYFRETIRRDIRQARERFSGPQLRQELARLQRRLDSVELLSPDIIMNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSASKRDERCCFLYALPPAQDVQLCFPSVGHCQWFCGLIQAWVTNPDSTAPAEEAEGAGEMLEFDYEYTETGERLVLGKGTYGVVYAGRDRHTRVRIAIKEIPERDSRFSQPLHEEIALHRRLRHKNIVRYLGSASQGGYLKIFMEEVPGGSLSSLLRSVWGPLKDNESTISFYTRQILQGLGYLHDNHIVHRDIKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGRLRAQGLGPALLHRPLFAFPDAVKQILRKRQIRPHWMFVLDSLLSRAVRAALGVLGPEVEKEAVSPRSEELSNEGDSQQSPGQQSPLPVEPEQGPAPLMVQLSLLRAETDRLREILAGKEREYQALVQRALQRLNEEARTYVLAPEPPTALSTDQGLVQWLQELNVDSGTIQMLLNHSFTLHTLLTYATRDDLIYTRIRGGMVCRIWRAILAQRAGSTPVTSGP

SEQ ID NO: 52576 - protein, 1280 aa, Homo sapiens
  Payload ID: 10477
  Gene Symbol: MAP3K6
  Gene Name: mitogen-activated protein kinase kinase kinase 6
  Uniprot ID: O95382
  ENSP ID: ENSP00000363152
MAGPCPRSGAERAGSCWQDPLAVALSRGRQLAAPPGRGCARSRPLSVVYVLTREPQPGLEPREGTEAEPLPLRCLREACAQVPRPRPPPQLRSLPFGTLELGDTAALDAFYNADVVVLEVSSSLVQPSLFYHLGVRESFSMTNNVLLCSQADLPDLQALRDCVGSYTLIPYVVTATGRVLCGDAGLLRGLADGLVQAGVGTEALLTPLVGRLARLLEATPTDSCGYFRETIRRDIRQARERFSGPQLRQELARLQRRLDSVELLSPDIIMNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSASKRDERCCFLYALPPAQDVQLCFPSVGHCQWFCGLIQAWVTNPDSTAPAEEAEGAGEMLEFDYEYTETGERLVLGKGTYGVVYAGRDRHTRVRIAIKEIPERDSRFSQPLHEEIALHRRLRHKNIVRYLGSASQGGYLKIFMEEVPGGSLSSLLRSVWGPLKDNESTISFYTRQILQGLGYLHDNHIVHRDIKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGRLRAQGLGPALLHRPLFAFPDAVKQILRKRQIRPHWMFVLDSLLSRAVRAALGVLGPEVEKEAVSPRSEELSNEGDSQQSPGQQSPLPVEPEQGPAPLMVQLSLLRAETDRLREILAGKEREYQALVQRALQRLNEEARTYVLAPEPPTALSTDQGLVQWLQELNVDSGTIQMLLNHSFTLHTLLTYATRDDLIYTRIRGGMVCRIWRAILAQRAGSTPVTSGP

SEQ ID NO: 52577 - protein, 798 aa, Homo sapiens
  Payload ID: 10477
  Gene Symbol: MAP3K6
  Gene Name: mitogen-activated protein kinase kinase kinase 6
  ENSP ID: ENSP00000418731
  MOD_RES (1)..(1): Any amino acid
XMNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSASKRDERCCFLYALPPAQDVQLCFPSVGHCQWFCGLIQAWVTNPDSTAPAEEAEGAGEMLEFDYEYTETGERLVLGKGTYGVVYAGRDRHTRVRIAIKEIPERDSRFSQPLHEEIALHRRLRHKNIVRYLGSASQGGYLKIFMEEVPGGSLSSLLRSVWGPLKDNESTISFYTRQILQGLGYLHDNHIVHRDIKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGWMNGEDKGSF

SEQ ID NO: 52578 - protein, 82 aa, Homo sapiens
  Payload ID: 10477
  Gene Symbol: MAP3K6
  Gene Name: mitogen-activated protein kinase kinase kinase 6
  ENSP ID: ENSP00000418932
  MOD_RES (1)..(1): Any amino acid
XEYQALVQRALQRLNEEARTYVLAPEPPTALSTDQGLVQWLQELNVDSGTIQMGRDGMPHLEGHLGTASRIHTSHLWTLRAE

SEQ ID NO: 52579 - protein, 1288 aa, Homo sapiens; identical to SEQ ID NO: 52575
  Payload ID: 10477
  Gene Symbol: MAP3K6
  Gene Name: mitogen-activated protein kinase kinase kinase 6
  Uniprot ID: O95382
  ENSP ID: ENSP00000419591

SEQ ID NO: 52580 - protein, 260 aa, Homo sapiens
  Payload ID: 10478
  Gene Symbol: MAP3K7
  Gene Name: mitogen-activated protein kinase kinase kinase 7
  ENSP ID: ENSP00000358326
MDIASTNTSNKSDTNMEQVPATNDTIKRLESKLLKNQAKQQSESGRLSLGASRGSSVESLPPTSEGKRMSADMSEIEARIAATTGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 52581 - protein, 518 aa, Homo sapiens
  Payload ID: 10478
  Gene Symbol: MAP3K7
  Gene Name: mitogen-activated protein kinase kinase kinase 7
  Uniprot ID: O43318
  ENSP ID: ENSP00000358331
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTAYSKPKRGHRKTASFGNILDVPEIVISGNGQPRRRSIQDLTVTGTEPGQVSSRSSSPSVRMITTSGPTSEKPTRSHPWTPDDSTDTNGSDNSIPMAYLTLDHQLQARTSCRTGPG

SEQ ID NO: 52582 - protein, 491 aa, Homo sapiens
  Payload ID: 10478
  Gene Symbol: MAP3K7
  Gene Name: mitogen-activated protein kinase kinase kinase 7
  Uniprot ID: O43318
  ENSP ID: ENSP00000358333
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTGNGQPRRRSIQDLTVTGTEPGQVSSRSSSPSVRMITTSGPTSEKPTRSHPWTPDDSTDTNGSDNSIPMAYLTLDHQLQARTSCRTGPG

SEQ ID NO: 52583 - protein, 606 aa, Homo sapiens
  Payload ID: 10478
  Gene Symbol: MAP3K7
  Gene Name: mitogen-activated protein kinase kinase kinase 7
  Uniprot ID: O43318
  ENSP ID: ENSP00000358335
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTAYSKPKRGHRKTASFGNILDVPEIVISGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 52584 - protein, 579 aa, Homo sapiens
  Payload ID: 10478
  Gene Symbol: MAP3K7
  Gene Name: mitogen-activated protein kinase kinase kinase 7
  Uniprot ID: O43318
  ENSP ID: ENSP00000358338
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 52585 - protein, 467 aa, Homo sapiens
  Payload ID: 10479
  Gene Symbol: MAP3K8
  Gene Name: mitogen-activated protein kinase kinase kinase 8
  Uniprot ID: P41279
  ENSP ID: ENSP00000263056
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIKPSNIVFMSTKAVLVDFGLSVQMTEDVYFPKDLRGTEIYMSPEVILCRGHSTKADIYSLGATLIHMQTGTPPWVKRYPRSAYPSYLYIIHKQAPPLEDIADDCSPGMRELIEASLERNPNHRPRAADLLKHEALNPPREDQPRCQSLDSALLERKRLLSRKELELPENIADSSCTGSTEESEMLKRQRSLYIDLGALAGYFNLVRGPPTLEYG

SEQ ID NO: 52586 - protein, 467 aa, Homo sapiens; identical to SEQ ID NO: 52585
  Payload ID: 10479
  Gene Symbol: MAP3K8
  Gene Name: mitogen-activated protein kinase kinase kinase 8
  Uniprot ID: P41279
  ENSP ID: ENSP00000364470

SEQ ID NO: 52587 - protein, 132 aa, Homo sapiens
  Payload ID: 10479
  Gene Symbol: MAP3K8
  Gene Name: mitogen-activated protein kinase kinase kinase 8
  ENSP ID: ENSP00000364471
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVRFFPISWVLCAQLSYCSFI

SEQ ID NO: 52588 - protein, 223 aa, Homo sapiens
  Payload ID: 10479
  Gene Symbol: MAP3K8
  Gene Name: mitogen-activated protein kinase kinase kinase 8
  ENSP ID: ENSP00000391275
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCG

SEQ ID NO: 52589 - protein, 255 aa, Homo sapiens
  Payload ID: 10479
  Gene Symbol: MAP3K8
  Gene Name: mitogen-activated protein kinase kinase kinase 8
  ENSP ID: ENSP00000409653
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIK

SEQ ID NO: 52590 - protein, 467 aa, Homo sapiens; identical to SEQ ID NO: 52585
  Payload ID: 10479
  Gene Symbol: MAP3K8
  Gene Name: mitogen-activated protein kinase kinase kinase 8
  Uniprot ID: P41279
  ENSP ID: ENSP00000443610

SEQ ID NO: 52591 - protein, 1081 aa, Homo sapiens
  Payload ID: 10480
  Gene Symbol: MAP3K9
  Gene Name: mitogen-activated protein kinase kinase kinase 9
  ENSP ID: ENSP00000370649
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGLKSLVDGYKQWSSSAPNLVKGPRSSPALPGFTSLMEMEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 52592 - protein, 837 aa, Homo sapiens
  Payload ID: 10480
  Gene Symbol: MAP3K9
  Gene Name: mitogen-activated protein kinase kinase kinase 9
  ENSP ID: ENSP00000451038
MSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQCETVSQISWGQNTQGHLSPALSSHRLVQACSIHNFCHLSSTMCIYMHILTPGESSKTWGRSSVVPKEEGEEEEKRAPKKKGRTWGPGTLGQKELASGDEGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 52593 - protein, 1118 aa, Homo sapiens
  Payload ID: 10480
  Gene Symbol: MAP3K9
  Gene Name: mitogen-activated protein kinase kinase kinase 9
  Uniprot ID: P80192
  ENSP ID: ENSP00000451263
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 52594 - protein, 1104 aa, Homo sapiens
  Payload ID: 10480
  Gene Symbol: MAP3K9
  Gene Name: mitogen-activated protein kinase kinase kinase 9
  Uniprot ID: P80192
  ENSP ID: ENSP00000451612
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 52595 - protein, 832 aa, Homo sapiens
  Payload ID: 10480
  Gene Symbol: MAP3K9
  Gene Name: mitogen-activated protein kinase kinase kinase 9
  ENSP ID: ENSP00000451921
MELTGLEVALVLILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 52596 - protein, 880 aa, Homo sapiens
  Payload ID: 10480
  Gene Symbol: MAP3K9
  Gene Name: mitogen-activated protein kinase kinase kinase 9
  ENSP ID: ENSP00000480011
MELTGLEVALVLILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQCETVSQISWGQNTQGHLSPALSSHRLVQACSIHNFCHLSSTMCIYMHILTPGESSKTWGRSSVVPKEEGEEEEKRAPKKKGRTWGPGTLGQKELASGDEGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 52597 - protein, 821 aa, Homo sapiens
  Payload ID: 10481
  Gene Symbol: MAP4K1
  Gene Name: mitogen-activated protein kinase kinase kinase kinase 1
  Uniprot ID: Q92918
  ENSP ID: ENSP00000380066
MDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRPVVVETRPVDDPTAPSNLYIQE

SEQ ID NO: 52598 - protein, 833 aa, Homo sapiens
  Payload ID: 10481
  Gene Symbol: MAP4K1
  Gene Name: mitogen-activated protein kinase kinase kinase kinase 1
  Uniprot ID: Q92918
  ENSP ID: ENSP00000465039
MDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRLECSGTISPHCNLLLPGSSNSPASASRVAGITGL

SEQ ID NO: 52599 - protein, 525 aa, Homo sapiens
  Payload ID: 10481
  Gene Symbol: MAP4K1
  Gene Name: mitogen-activated protein kinase kinase kinase kinase 1
  ENSP ID: ENSP00000465303
  MOD_RES (1)..(1): Any amino acid
XSSSLGIPDADCCRRHMEFRKLRGMETRPPANTARLQPPRDLRSSSPRSGTPGRMGRGLECGQGPQGSYLSPFRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRPVVVETRPVDDPTAPSNLYIQE

SEQ ID NO: 52600 - protein, 395 aa, Homo sapiens
  Payload ID: 10481
  Gene Symbol: MAP4K1
  Gene Name: mitogen-activated protein kinase kinase kinase kinase 1
  ENSP ID: ENSP00000465774
MDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCQLQAFWKHGVQVWALGSDQLLQELRDPTLTFRLLGSPRPVVVETRPVDDPTAPSNLYIQE

SEQ ID NO: 52601 - protein, 817 aa, Homo sapiens
  Payload ID: 10481
  Gene Symbol: MAP4K1
  Gene Name: mitogen-activated protein kinase kinase kinase kinase 1
  ENSP ID: ENSP00000468164
MAKFRGRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRPVVVETRPVDDPTAPSNLYIQE

SEQ ID NO: 52602 - protein, 69 aa, Homo sapiens
  Payload ID: 10481
  Gene Symbol: MAP4K1
  Gene Name: mitogen-activated protein kinase kinase kinase kinase 1
  ENSP ID: ENSP00000468396
  MOD_RES (1)..(1): Any amino acid
XGATLARRLSFIGTPYWMAPEVAAVALKGGYNELCDIWSLGITAIELAELQPPLFDVHPLSINWYPSLG

SEQ ID NO: 52603 - protein, 817 aa, Homo sapiens; identical to SEQ ID NO: 52601
  Payload ID: 10481
  Gene Symbol: MAP4K1
  Gene Name: mitogen-activated protein kinase kinase kinase kinase 1
  ENSP ID: ENSP00000488949

SEQ ID NO: 52604 - protein, 833 aa, Homo sapiens; identical to SEQ ID NO: 52598
  Payload ID: 10481
  Gene Symbol: MAP4K1
  Gene Name: mitogen-activated protein kinase kinase kinase kinase 1
  ENSP ID: ENSP00000489001

SEQ ID NO: 52605 - protein, 395 aa, Homo sapiens; identical to SEQ ID NO: 52600
  Payload ID: 10481
  Gene Symbol: MAP4K1
  Gene Name: mitogen-activated protein kinase kinase kinase kinase 1
  ENSP ID: ENSP00000489009

SEQ ID NO: 52606 - protein, 69 aa, Homo sapiens; identical to SEQ ID NO: 52602
  Payload ID: 10481
  Gene Symbol: MAP4K1
  Gene Name: mitogen-activated protein kinase kinase kinase kinase 1
  ENSP ID: ENSP00000489075
  MOD_RES (1)..(1): Any amino acid

SEQ ID NO: 52607 - protein, 821 aa, Homo sapiens; identical to SEQ ID NO: 52597
  Payload ID: 10481
  Gene Symbol: MAP4K1
  Gene Name: mitogen-activated protein kinase kinase kinase kinase 1
  ENSP ID: ENSP00000489158

SEQ ID NO: 52608 - protein, 525 aa, Homo sapiens; identical to SEQ ID NO: 52599
  Payload ID: 10481
  Gene Symbol: MAP4K1
  Gene Name: mitogen-activated protein kinase kinase kinase kinase 1
  ENSP ID: ENSP00000489418
  MOD_RES (1)..(1): Any amino acid

SEQ ID NO: 52609 - protein, 820 aa, Homo sapiens
  Payload ID: 10482
  Gene Symbol: MAP4K2
  Gene Name: mitogen-activated protein kinase kinase kinase kinase 2
  Uniprot ID: Q12851
  ENSP ID: ENSP00000294066
MALLRDVSLQDPRDRFELLQRVGAGTYGDVYKARDTVTSELAAVKIVKLDPGDDISSLQQEITILRECRHPNVVAYIGSYLRNDRLWICMEFCGGGSLQEIYHATGPLEERQIAYVCREALKGLHHLHSQGKIHRDIKGANLLLTLQGDVKLADFGVSGELTASVAKRRSFIGTPYWMAPEVAAVERKGGYNELCDVWALGITAIELGELQPPLFHLHPMRALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEPWEEEWTLLGKEELSGSLLQSVQEALEERSLTIRSASEFQELDSPDDTMGTIKRAPFLGPLPTDPPAEEPLSSPPGTLPPPPSGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 52610 - protein, 812 aa, Homo sapiens
  Payload ID: 10482
  Gene Symbol: MAP4K2
  Gene Name: mitogen-activated protein kinase kinase kinase kinase 2
  Uniprot ID: Q12851
  ENSP ID: ENSP00000366567
MALLRDVSLQDPRDRFELLQRVGAGTYGDVYKARDTVTSELAAVKIVKLDPGDDISSLQQEITILRECRHPNVVAYIGSYLRNDRLWICMEFCGGGSLQEIYHATGPLEERQIAYVCREALKGLHHLHSQGKIHRDIKGANLLLTLQGDVKLADFGVSGELTASVAKRRSFIGTPYWMAPEVAAVERKGGYNELCDVWALGITAIELGELQPPLFHLHPMRALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEPWEEEWTLLGKEELSGSLLQSVQEALEERSLTIRSASEFQELDSPDDTMGTIKRAPFLGPLPTDPPAEEPLSSPPGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 52611 - protein, 57 aa, Homo sapiens
  Payload ID: 10482
  Gene Symbol: MAP4K2
  Gene Name: mitogen-activated protein kinase kinase kinase kinase 2
  ENSP ID: ENSP00000400594
MALLRDVSLQDPRDRFELLQRVGAGTYGDVYKARDTVTSELAAVKIVKLDPGNHHPA

SEQ ID NO: 52612 - protein, 144 aa, Homo sapiens
  Payload ID: 10482
  Gene Symbol: MAP4K2
  Gene Name: mitogen-activated protein kinase kinase kinase kinase 2
  ENSP ID: ENSP00000403410
  MOD_RES (1)..(1): Any amino acid
XSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHARPSR

SEQ ID NO: 52613 - protein, 307 aa, Homo sapiens
  Payload ID: 10482
  Gene Symbol: MAP4K2
  Gene Name: mitogen-activated protein kinase kinase kinase kinase 2
  ENSP ID: ENSP00000403563
MALLRDVSLQDPRDRFELLQRVGAGTYGDVYKARDTVTSELAAVKIVKLDPGDDISSLQQEITILRECRHPNVVAYIGSYLRNDRLWICMEFCGGGSLQEIYHATGPLEERQIAYVCREALKGLHHLHSQGKIHRDIKGANLLLTLQGDVKLADFGVSGELTASVAKRRSFIGTPYWALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEP

SEQ ID NO: 52614 - protein, 58 aa, Homo sapiens
  Payload ID: 10482
  Gene Symbol: MAP4K2
  Gene Name: mitogen-activated protein kinase kinase kinase kinase 2
  ENSP ID: ENSP00000404534
MALLRDVSLQDPRDRFELLQRVGAGTYGDVYKARDTVTSELAAVKIVKLDPAGNHHPA

SEQ ID NO: 52615 - protein, 57 aa, Homo sapiens; identical to SEQ ID NO: 52611
  Payload ID: 10482
  Gene Symbol: MAP4K2
  Gene Name: mitogen-activated protein kinase kinase kinase kinase 2
  ENSP ID: ENSP00000413167

SEQ ID NO: 52616 - protein, 894 aa, Homo sapiens
  Payload ID: 10483
  Gene Symbol: MAP4K3
  Gene Name: mitogen-activated protein kinase kinase kinase kinase 3
  Uniprot ID: Q8IVH8
  ENSP ID: ENSP00000263881
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELPDSDGFLDSSEEIYYTARSNLDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 52617 - protein, 873 aa, Homo sapiens
  Payload ID: 10483
  Gene Symbol: MAP4K3
  Gene Name: mitogen-activated protein kinase kinase kinase kinase 3
  Uniprot ID: Q8IVH8
  ENSP ID: ENSP00000345434
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 52618 - protein, 143 aa, Homo sapiens
  Payload ID: 10483
  Gene Symbol: MAP4K3
  Gene Name: mitogen-activated protein kinase kinase kinase kinase 3
  ENSP ID: ENSP00000399228
FQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELPDSDGFLDSSEEIYYTARSNL

SEQ ID NO: 52619 - protein, 131 aa, Homo sapiens
  Payload ID: 10483
  Gene Symbol: MAP4K3
  Gene Name: mitogen-activated protein kinase kinase kinase kinase 3
  ENSP ID: ENSP00000405137
MNPGFDLSRRNPQEDFELIQRIGSGTYGDVYKARNVNTGELAAIKVIKLEPGEDFAVVQQEIIMMKDCKHPNIVAYFGSYLRRDKLWICMEFCGGGSLQDIYHGWLQKLQLLRGRGVTINSVISGQWESLP

SEQ ID NO: 52620 - protein, 44 aa, Homo sapiens
  Payload ID: 10483
  Gene Symbol: MAP4K3
  Gene Name: mitogen-activated protein kinase kinase kinase kinase 3
  ENSP ID: ENSP00000410183
MNPGFDLSRRNPQEDFELIQRIGSGTYGDVYKEKTLQLCSKKLL

SEQ ID NO: 52621 - protein, 810 aa, Homo sapiens
  Payload ID: 10483
  Gene Symbol: MAP4K3
  Gene Name: mitogen-activated protein kinase kinase kinase kinase 3
  ENSP ID: ENSP00000416958
MMKDCKHPNIVAYFGSYLRRDKLWICMEFCGGGSLQDIYHVTGPLSELQIAYVSRETLQGLYYLHSKGKMHRDIKGANILLTDNGHVKLADFGVSAQITATIAKRKSFIGTPYWMAPEVAAVERKGGYNQLCDLWAVGITAIELAELQPPMFDLHPMRALFLMTKSNFQPPKLKDKMKWSNSFHHFVKMALTKNPKKRPTAEKLLQHPFVTQHLTRSLAIELLDKVNNPDHSTYHDFDDDDPEPLVAVPHRIHSTSRNVREEKTRSEITFGQVKFDPPLRKETEPHHELDLQLEYGQGHQGGYFLGANKSLLKSVEEELHQRGHVAHLEDDEGDDDESKHSTLKAKIPPPLPPKPKSIFIPQEMHSTEDENQGTIKRCPMSGSPAKPSQVPPRPPPPRLPPHKPVALGNGMSSFQLNGERDGSLCQQQNEHRGTNLSRKEKKDVPKPISNGLPPTPKVHMGACFSKVFNGCPLKIHCASSWINPDTRDQYLIFGAEEGIYTLNLNELHETSMEQLFPRRCTWLYVMNNCLLSISGKASQLYSHNLPGLFDYARQMQKLPVAIPAHKLPDRILPRKFSVSAKIPETKWCQKCCVVRNPYTGHKYLCGALQTSIVLLEWVEPMQKFMLIKHIDFPIPCPLRMFEMLVVPEQEYPLVCVGVSRGRDFNQVVRFETVNPNSTSSWFTESDTPQTNVTHVTQLERDTILVCLDCCIKIVNLQGRLKSSRKLSSELTFDFQIESIVCLQDSVLAFWKHGMQGRSFRSNEVTQEISDSTRIFRLLGSDRVVVLESRPTDNPTANSNLYILAGHENSY

SEQ ID NO: 52622 - protein, 92 aa, Homo sapiens
  Payload ID: 10483
  Gene Symbol: MAP4K3
  Gene Name: mitogen-activated protein kinase kinase kinase kinase 3
  ENSP ID: ENSP00000476533
MNPGFDLSRRNPQEDFELIQRIGSGTYGDVYKARNVNTGELAAIKVIKLEPGEDFAVVQQEIIMMKDCKHPNIVAYFGSYLRYTVCFPFEKQ

SEQ ID NO: 52623 - protein, 1165 aa, Homo sapiens [sequence omitted]

SEQ ID NO: 52624 - protein, 987 aa, Homo sapiens
  Payload ID: 10484
  Gene Symbol: MAP4K4
  Gene Name: mitogen-activated protein kinase kinase kinase kinase 4
  ENSP ID: ENSP00000303600
MDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAGEVDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 52625 - protein, 1235 aa, Homo sapiens
  Payload ID: 10484
  Gene Symbol: MAP4K4
  Gene Name: mitogen-activated protein kinase kinase kinase kinase 4
  ENSP ID: ENSP00000313644
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVQWSHLASLKNNVSPVSRSHSFSDPSPKFAHHHLRSQDPCPPSRSEVLSQSSDSKSEAPDPTQKAWSRSDSDEVPPRVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAVRIDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 52626 - protein, 1239 aa, Homo sapiens
  Payload ID: 10484
  Gene Symbol: MAP4K4
  Gene Name: mitogen-activated protein kinase kinase kinase kinase 4
  Uniprot ID: O95819
  ENSP ID: ENSP00000314363
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVPVRTTSRSPVLSRRDSPLQGSGQQNSQAGQRNSTSIEPRLLWERVEKLVPRPGSGSSSGSSNSGSQPGSHPGSQSGSGERFRVRSSSKSEGSPSQRLENAVKKPEDKKEVFRPLKPADLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 52627 - protein, 1273 aa, Homo sapiens
  Payload ID: 10484
  Gene Symbol: MAP4K4
  Gene Name: mitogen-activated protein kinase kinase kinase kinase 4
  ENSP ID: ENSP00000343658
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPADLTALAKELRAVEDVRPPHKVTDYSSSSEESGTTDEEDDDVEQEGADESTSGPEDTRAASSLNLSNGETESVKTMIVHDDVESEPAMTPSKEGTLIVRQSTVDQKRASHHESNGFAGRIHLLPDLLQQSHSSSTSSTSSSPSSSQPTPTMSPQTPQDKLTANETQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 52628 - protein, 1038 aa, Homo sapiens
  Payload ID: 10484
  Gene Symbol: MAP4K4
  Gene Name: mitogen-activated protein kinase kinase kinase kinase 4
  ENSP ID: ENSP00000387370
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVPVRTTSRSPVLSRRDSPLQGSGQQNSQAGQRNSTSIEPRLLWERVEKLVPRPGSGSSSGSSNSGSQPGSHPGSQSGSGERFRVRSSSKSEGSPSQRLENAVKKPEDKKEVFRPLKPADLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 52629 - protein, 1154 aa, Homo sapiens
  Payload ID: 10484
  Gene Symbol: MAP4K4
  Gene Name: mitogen-activated protein kinase kinase kinase kinase 4
  ENSP ID: ENSP00000389752
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVPVRTTSRSPVLSRRDSPLQGSGQQNSQAGQRNSTSIEPRLLWERVEKLVPRPGSGSSSGSSNSGSQPGSHPGSQSGSGERFRVRSSSKSEGSPSQRLENAVKKPEDKKEVFRPLKPADLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 52630 - protein, 1272 aa, Homo sapiens
  Payload ID: 10484
  Gene Symbol: MAP4K4
  Gene Name: mitogen-activated protein kinase kinase kinase kinase 4
  ENSP ID: ENSP00000392830
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVPVRTTSRSPVLSRRDSPLQGSGQQNSQAGQRNSTSIEPRLLWERVEKLVPRPGSGSSSGSSNSGSQPGSHPGSQSGSGERFRVRSSSKSEGSPSQRLENAVKKPEDKKEVFRPLKPADLTALAKELRAVEDVRPPHKVTDYSSSSEESGTTDEEDDDVEQEGADESTSGPEDTRAASSLNLSNGETESVKTMIVHDDVESEPAMTPSKEGTLIVRQSTVDQKRASHHESNGFAGRIHLLPDLLQQSHSSSTSSTSSSPSSSQPTPTMSPQTPQDKLTANETQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 52631 - protein, 1056 aa, Homo sapiens
  Payload ID: 10484
  Gene Symbol: MAP4K4
  Gene Name: mitogen-activated protein kinase kinase kinase kinase 4
  ENSP ID: ENSP00000396066
  MOD_RES (1)..(1): Any amino acid
XFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVQWSHLASLKNNVSPVSRSHSFSDPSPKFAHHHLRSQDPCPPSRSEVLSQSSDSKSEAPDPTQKAWSRSDSDEVPPRVPVRTTSRSPVLSRRDSPLQGSGQQNSQAGQRNSTSIEPRLLWERVEKLVPRPGSGSSSGSSNSGSQPGSHPGSQSGSGERFRVRSSSKSEGSPSQRLENAVKKPEDKKEVFRPLKPADLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 52632 - protein, 102 aa, Homo sapiens
  Payload ID: 10484
  Gene Symbol: MAP4K4
  Gene Name: mitogen-activated protein kinase kinase kinase kinase 4
  ENSP ID: ENSP00000403016
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLW

SEQ ID NO: 52633 - protein, 1170 aa, Homo sapiens
  Payload ID: 10484
  Gene Symbol: MAP4K4
  Gene Name: mitogen-activated protein kinase kinase kinase kinase 4
  ENSP ID: ENSP00000409720
VYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVPVRTTSRSPVLSRRDSPLQGSGQQNSQAGQRNSTSIEPRLLWERVEKLVPRPGSGSSSGSSNSGSQPGSHPGSQSGSGERFRVRSSSKSEGSPSQRLENAVKKPEDKKEVFRPLKPADLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 52634 - protein, 258 aa, Homo sapiens
  Payload ID: 10484
  Gene Symbol: MAP4K4
  Gene Name: mitogen-activated protein kinase kinase kinase kinase 4
  ENSP ID: ENSP00000414766
QQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVQWSHLASLKNNVSPVSRSHSFSDPSPKFAHHHLRSQDPCPPSRSEVLSQSSDSKSEAPDPTQKAWSRSDSDEVPPRVPVRTTSRSPVLSRRDSPLQGSGQ

SEQ ID NO: 52635 - protein, 1320 aa, Homo sapiens
  Payload ID: 10484
  Gene Symbol: MAP4K4
  Gene Name: mitogen-activated protein kinase kinase kinase kinase 4
  ENSP ID: ENSP00000486116
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLECRWREMEEHRQAERLQRQLQQEQAYLLSLQHDHRRPHPQHSQQPPPPQQERSKPSFHAPEPKAHYEPADRAREVEDRFRKTNHSSPEAQSKQTGRVLEPPVPSRSESFSNGNSESVHPALQRPAEPQVQWSHLASLKNNVSPVSRSHSFSDPSPKFAHHHLRSQDPCPPSRSEVLSQSSDSKSEAPDPTQKAWSRSDSDEVPPRVPVRTTSRSPVLSRRDSPLQGSGQQNSQAGQRNSTSSIEPRLLWERVEKLVPRPGSGSSSGSSNSGSQPGSHPGSQSGSGERFRVRSSSKSEGSPSQRLENAVKKPEDKKEVFRPLKPAVRIDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 52636 - protein, 1044 aa, Homo sapiens [sequence omitted]

SEQ ID NO: 52637 - protein, 1165 aa, Homo sapiens
  Payload ID: 10484
  Gene Symbol: MAP4K4
  Gene Name: mitogen-activated protein kinase kinase kinase kinase 4
  ENSP ID: ENSP00000489579
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKSKKWSKKFFSFIEGCLVKNYMQRPSTEQLLKHPFIRDQPNERQVRIQLKDHIDRTRKKRGEKDETEYEYSGSEEEEEEVPEQEGEPSSIVNVPGESTLRRDFLRLQQENKERSEALRRQQLLQEQQLREQEEYKRQLLAERQKRIEQQKEQRRRLEEQQRREREARRQQEREQRRREQEEKRRLEELERRRKEEEERRRAEEEKRRVEREQEYIRRQLEEEQRHLEVLQQQLLQEQAMLLHDHRRPHPQHSQQPPPPQQERSKPSFHAPEPKAHYEPADRAREVPVRTTSRSPVLSRRDSPLQGSGQQNSQAGQRNSTSIEPRLLWERVEKLVPRPGSGSSSGSSNSGSQPGSHPGSQSGSGERFRVRSSSKSEGSPSQRLENAVKKPEDKKEVFRPLKPAGEVDLTALAKELRAVEDVRPPHKVTDYSSSSEESGTTDEEDDDVEQEGADESTSGPEDTRAASSLNLSNGETESVKTMIVHDDVESEPAMTPSKEGTLIVRQTQSASSTLQKHKSSSSFTPFIDPRLLQISPSSGTTVTSVVGFSCDGMRPEAIRQDPTRKGSVVNVNPTNTRPQSDTPEIRKYKKRFNSEILCAALWGVNLLVGTESGLMLLDRSGQGKVYPLINRRRFQQMDVLEGLNVLVTISGKKDKLRVYYLSWLRNKILHNDPEVEKKQGWTTVGDLEGCVHYKVVKYERIKFLVIALKSSVEVYAWAPKPYHKFMAFKSFGELVHKPLLVDLTVEEGQRLKVIYGSCAGFHAVDVDSGSVYDIYLPTHVRKNPHSMIQCSIKPHAIIILPNTDGMELLVCYEDEGVYVNTYGRITKDVVLQWGEMPTSVAYIRSNQTMGWGEKAIEIRSVETGHLDGVFMHKRAQRLKFLCERNDKVFFASVRSGGSSQVYFMTLGRTSLLSW

SEQ ID NO: 52638 - protein, 846 aa, Homo sapiens
  Payload ID: 10485
  Gene Symbol: MAP4K5
  Gene Name: mitogen-activated protein kinase kinase kinase kinase 5
  ENSP ID: ENSP00000013125
MEAPLRPAADILRRNPQQDYELVQRVGSGTYGDVYKARNVHTGELAAVKIIKLEPGDDFSLIQQEIFMVKECKHCNIVAYFGSYLSREKLWICMEYCGGGSLQDIYHVTGPLSELQIAYVCRETLQGLAYLHTKGKMHRDIKGANILLTDHGDVKLADFGVAAKITATIAKRKSFIGTPYWMAPEVAAVEKNGGYNQLCDIWAVGITAIELGELQPPMFDLHPMRALFLMSKSNFQPPKLKDKTKWSSTFHNFVKIALTKNPKKRPTAERLLTHTFVAQPGLSRALAVELLDKVNNPDNHAHYTEADDDDFEPHAIIRHTIRSTNRNARAERTASEINFDKLQFEPPLRKETEARDEMGLSSDPNFMLQWNPFVDGANTGKSTSKRAIPPPLPPKPRISSYPEDNFPDEEKASTIKHCPDSESRAPQILRRQSSPSCGPVAETSSIGNGDGISKLMSENTEGSAQAPQLPRKKDKRDFPKPAINGLPPTPKVLMGACFSKVFDGCPLKINCATSWIHPDTKDQYIIFGTEDGIYTLNLNELHEATMEQLFPRKCTWLYVINNTLMSLSVGKTFQLYSHNLIALFEHAKKPGLAAHIQTHRFPDRILPRKFALTTKIPDTKGCHKCCIVRNPYTGHKYLCGALQSGIVLLQWYEPMQKFMLIKHFDFPLPSPLNVFEMLVIPEQEYPMVCVAISKGTESNQVVQFETINLNSASSWFTEIGAGSQQLDSIHVTQLERDTVLVCLDKFVKIVNLQGKLKSSKKLASELSFDFRIESVVCLQDSVLAFWKHGMQGKSFKSDEVTQEISDETRVFRLLGSDRVVVLESRPTENPTAHSNLYILAGHENSY

SEQ ID NO: 52639 - protein, 55 aa, Homo sapiens
  Payload ID: 10485
  Gene Symbol: MAP4K5
  Gene Name: mitogen-activated protein kinase kinase kinase kinase 5
  ENSP ID: ENSP00000451452
MEAPLRPAADILRRNPQQDYELVQRVGSGTYGDVYKARNVHTGELAAVKIIKLEP

SEQ ID NO: 52640 - protein, 62 aa, Homo sapiens
  Payload ID: 10485
  Gene Symbol: MAP4K5
  Gene Name: mitogen-activated protein kinase kinase kinase kinase 5
  ENSP ID: ENSP00000451926
MEAPLRPAADILRRNPQQDYELVQRVGSGTYGDVYKARNVHTGELAAVKIIKLEPGSCLFAY

SEQ ID NO: 52641 - protein, 137 aa, Homo sapiens
  Payload ID: 10485
  Gene Symbol: MAP4K5
  Gene Name: mitogen-activated protein kinase kinase kinase kinase 5
  ENSP ID: ENSP00000451980
MEAPLRPAADILRRNPQQDYELVQRVGSGTYGDVYKARNVHTGELAAVKIIKLEPGDDFSLIQQEIFMVKECKHCNIVAYFGSYLSREKLWICMEYCGGGSLQDIYHVTGPLSELQIAYVCRETLQGLAYLHTKGKM

SEQ ID NO: 52642 - protein, 108 aa, Homo sapiens
  Payload ID: 10485
  Gene Symbol: MAP4K5
  Gene Name: mitogen-activated protein kinase kinase kinase kinase 5
  ENSP ID: ENSP00000452289
MVKECKHCNIVAYFGSYLSREKLWICMEYCGGGSLQDIYHVTGPLSELQIAYVCRETLQGLAYLHTKGKMHRDIKGANILLTDHGDVKLADFGVAAKITATIAKRKSF

SEQ ID NO: 52643 - protein, 482 aa, Homo sapiens
  Payload ID: 10486
  Gene Symbol:
  Gene Name: Mitogen-activated protein kinase kinase kinase MLK4  [Source:UniProtKB/Swiss-Prot
  Acc:Q5TCX8]
  ENSP ID: ENSP00000355581
MFFLVTSDESNKTWGRNTVFRQEEFEDVKRNFKKKGCTWGPNSIQMKDRTDCKERIRPLSDGNSPWSTILIKNQKTMPLASLFVDQPGSCEEPKLSPDGLEHRKPKQIKLPSQAYIDLPLGKDAQRENPAEAESWEEAASANAATVSIEMTPTNSLSRSPQRKKTESALYGCTVLLASVALGLDLRELHKAQAAEEPLPKEEKKKREGIFQRASKSRRSASPPTSLPSTCGEASSPPSLPLSSALGILSTPSFSTKCLLQMDSEDPLVDSAPVTCDSEMLTPDFCPTAPGSGREPALMPRLDTDCSVSRNLPSSFLQQTCGNVPYCASSKHRPSHHRRTMSDGNPTPTGATIISATGASALPLCPSPAPHSHLPREVSPKKHSTVHIVPQRRPASLRSRSDLPQAYPQTAVSQLAQTACVVGRPGPHPTQFLAAKERTKSHVPSLLDADVEGQSRDYTVPLCRMRSKTSRPSIYELEKEFLS

SEQ ID NO: 52644 - protein, 570 aa, Homo sapiens
  Payload ID: 10486
  Gene Symbol:
  Gene Name: Mitogen-activated protein kinase kinase kinase MLK4  [Source:UniProtKB/Swiss-Prot
  Acc:Q5TCX8]
  ENSP ID: ENSP00000355582
MALRGAAGATDTPVSSAGGAPGGSASSSSTSSGGSASAGAGLWAALYDYEARGEDELSLRRGQLVEVLSQDAAVSGDEGWWAGQVQRRLGIFPANYVAPCRPAASPAPPPSRPSSPVHVAFERLELKELIGAGGFGQVYRATWQGQEVAVKAARQDPEQDAAAAAESVRREARLFAMLRHPNIIELRGVCLQQPHLCLVLEFARGGALNRALAAANAAPDPRAPGPRRARRIPPHVLVNWAVQIARGMLYLHEEAFVPILHRDLKSSNILLLEKIEHDDICNKTLKITDFGLAREWHRTTKMSTAGTYAWMAPEVIKSSLFSKGSDIWSYGVLLWELLTGEVPYRGIDGLAVAYGVAVNKLTLPIPSTCPEPFAKLMKECWQQDPHIRPSFALILEQLTAIEGAVMTEMPQESFHSMQDDWKLEIQQMFDELRTKEKELRSREEELTRAALQQKSQEELLKRREQQLAEREIDVLERELNILIFQLNQEKPKVKKRKGKFKRSRLKLKDGHRISLPSDFQHKITVQASPNLDKRRSLNSSSSSPPSSPTMMPRLRAIQCELSALPRGLLC

SEQ ID NO: 52645 - protein, 1036 aa, Homo sapiens
  Payload ID: 10486
  Gene Symbol:
  Gene Name: Mitogen-activated protein kinase kinase kinase MLK4  [Source:UniProtKB/Swiss-Prot
  Acc:Q5TCX8]
  Uniprot ID: Q5TCX8
  ENSP ID: ENSP00000355583
MALRGAAGATDTPVSSAGGAPGGSASSSSTSSGGSASAGAGLWAALYDYEARGEDELSLRRGQLVEVLSQDAAVSGDEGWWAGQVQRRLGIFPANYVAPCRPAASPAPPPSRPSSPVHVAFERLELKELIGAGGFGQVYRATWQGQEVAVKAARQDPEQDAAAAAESVRREARLFAMLRHPNIIELRGVCLQQPHLCLVLEFARGGALNRALAAANAAPDPRAPGPRRARRIPPHVLVNWAVQIARGMLYLHEEAFVPILHRDLKSSNILLLEKIEHDDICNKTLKITDFGLAREWHRTTKMSTAGTYAWMAPEVIKSSLFSKGSDIWSYGVLLWELLTGEVPYRGIDGLAVAYGVAVNKLTLPIPSTCPEPFAKLMKECWQQDPHIRPSFALILEQLTAIEGAVMTEMPQESFHSMQDDWKLEIQQMFDELRTKEKELRSREEELTRAALQQKSQEELLKRREQQLAEREIDVLERELNILIFQLNQEKPKVKKRKGKFKRSRLKLKDGHRISLPSDFQHKITVQASPNLDKRRSLNSSSSSPPSSPTMMPRLRAIQLTSDESNKTWGRNTVFRQEEFEDVKRNFKKKGCTWGPNSIQMKDRTDCKERIRPLSDGNSPWSTILIKNQKTMPLASLFVDQPGSCEEPKLSPDGLEHRKPKQIKLPSQAYIDLPLGKDAQRENPAEAESWEEAASANAATVSIEMTPTNSLSRSPQRKKTESALYGCTVLLASVALGLDLRELHKAQAAEEPLPKEEKKKREGIFQRASKSRRSASPPTSLPSTCGEASSPPSLPLSSALGILSTPSFSTKCLLQMDSEDPLVDSAPVTCDSEMLTPDFCPTAPGSGREPALMPRLDTDCSVSRNLPSSFLQQTCGNVPYCASSKHRPSHHRRTMSDGNPTPTGATIISATGASALPLCPSPAPHSHLPREVSPKKHSTVHIVPQRRPASLRSRSDLPQAYPQTAVSQLAQTACVVGRPGPHPTQFLAAKERTKSHVPSLLDADVEGQSRDYTVPLCRMRSKTSRPSIYELEKEFLS

SEQ ID NO: 52646 - protein, 455 aa, Homo sapiens
  Payload ID: 10487
  Gene Symbol:
  Gene Name: Mitogen-activated protein kinase kinase kinase MLT  [Source:UniProtKB/Swiss-Prot
  Acc:Q9NYL2]
  ENSP ID: ENSP00000340257
MSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPLLLPLAARMSEESYFESKTEESNSAEMSCQITATSNGEGHGMNPSLQAMMLMGFGDIFSMNKAGAVMHSGMQINMQAKQNSSKTTSKRRGKKVNMALGFSDFDLSEGDDDDDDDGEEEDNDMDNSE

SEQ ID NO: 52647 - protein, 800 aa, Homo sapiens
  Payload ID: 10487
  Gene Symbol:
  Gene Name: Mitogen-activated protein kinase kinase kinase MLT  [Source:UniProtKB/Swiss-Prot
  Acc:Q9NYL2]
  Uniprot ID: Q9NYL2
  ENSP ID: ENSP00000364361
MSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPLLPSFEIGAWTEDDVYCWVQQLVRKGDSSAEMSVYASLFKENNITGKRLLLLEEEDLKDMGIVSKGHIIHFKSAIEKLTHDYINLFHFPPLIKDSGGEPEENEEKIVNLELVFGFHLKPGTGPQDCKWKMYMEMDGDEIAITYIKDVTFNTNLPDAEILKMTKPPFVMEKWIVGIAKSQTVECTVTYESDVRTPKSTKHVHSIQWSRTKPQDEVKAVQLAIQTLFTNSDGNPGSRSDSSADCQWLDTLRMRQIASNTSLQRSQSNPILGSPFFSHFDGQDSYAAAVRRPQVPIKYQQITPVNQSRSSSPTQYGLTKNFSSLHLNSRDSGFSSGNTDTSSERGRYSDRSRNKYGRGSISLNSSPRGRYSGKSQHSTPSRGRYPGKFYRVSQSALNPHQSPDFKRSPRDLHQPNTIPGMPLHPETDSRASEEDSKVSEGGWTKVEYRKKPHRPSPAKTNKERARGDHRGWRNF

SEQ ID NO: 52648 - protein, 800 aa, Homo sapiens; identical to SEQ ID NO: 52647
  Payload ID: 10487
  Gene Symbol:
  Gene Name: Mitogen-activated protein kinase kinase kinase MLT  [Source:UniProtKB/Swiss-Prot
  Acc:Q9NYL2]
  Uniprot ID: Q9NYL2
  ENSP ID: ENSP00000387259

SEQ ID NO: 52649 - protein, 138 aa, Homo sapiens
  Payload ID: 10487
  Gene Symbol:
  Gene Name: Mitogen-activated protein kinase kinase kinase MLT  [Source:UniProtKB/Swiss-Prot
  Acc:Q9NYL2]
  ENSP ID: ENSP00000411923
MSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRN

SEQ ID NO: 52650 - protein, 455 aa, Homo sapiens; identical to SEQ ID NO: 52646
  Payload ID: 10487
  Gene Symbol:
  Gene Name: Mitogen-activated protein kinase kinase kinase MLT  [Source:UniProtKB/Swiss-Prot
  Acc:Q9NYL2]
  ENSP ID: ENSP00000439414

SEQ ID NO: 52651 - protein, 370 aa, Homo sapiens
  Payload ID: 10488
  Gene Symbol: MAPKAPK2
  Gene Name: mitogen-activated protein kinase-activated protein kinase 2
  Uniprot ID: P49137
  ENSP ID: ENSP00000294981
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKGCLHDKNSDQATWLTRL

SEQ ID NO: 52652 - protein, 400 aa, Homo sapiens
  Payload ID: 10488
  Gene Symbol: MAPKAPK2
  Gene Name: mitogen-activated protein kinase-activated protein kinase 2
  Uniprot ID: P49137
  ENSP ID: ENSP00000356070
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKEEMTSALATMRVDYEQIKIKKIEDASNPLLLKRRKKARALEAAALAH

SEQ ID NO: 52653 - protein, 382 aa, Homo sapiens
  Payload ID: 10489
  Gene Symbol: MAPKAPK3
  Gene Name: mitogen-activated protein kinase-activated protein kinase 3
  Uniprot ID: Q16644
  ENSP ID: ENSP00000350639
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAKQLIRLLLKTDPTERLTITQFMNHPWINQSMVVPQTPLHTARVLQEDKDHWDEVKEEMTSALATMRVDYDQVKIKDLKTSNNRLLNKRRKKQAGSSSASQGCNNQ

SEQ ID NO: 52654 - protein, 97 aa, Homo sapiens
  Payload ID: 10489
  Gene Symbol: MAPKAPK3
  Gene Name: mitogen-activated protein kinase-activated protein kinase 3
  ENSP ID: ENSP00000394894
  MOD_RES (1)..(1): Any amino acid
XLGQYGFPNPEWSEVSEDAKQLIRLLLKTDPTERLTITQFMNHPWINEEMTSALATMRVDYDQVKIKDLKTSNNRLLNKRRKKQAGSSSASQGCNNQ

SEQ ID NO: 52655 - protein, 382 aa, Homo sapiens; identical to SEQ ID NO: 52653
  Payload ID: 10489
  Gene Symbol: MAPKAPK3
  Gene Name: mitogen-activated protein kinase-activated protein kinase 3
  Uniprot ID: Q16644
  ENSP ID: ENSP00000396467

SEQ ID NO: 52656 - protein, 119 aa, Homo sapiens
  Payload ID: 10489
  Gene Symbol: MAPKAPK3
  Gene Name: mitogen-activated protein kinase-activated protein kinase 3
  ENSP ID: ENSP00000402045
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIME

SEQ ID NO: 52657 - protein, 332 aa, Homo sapiens
  Payload ID: 10489
  Gene Symbol: MAPKAPK3
  Gene Name: mitogen-activated protein kinase-activated protein kinase 3
  ENSP ID: ENSP00000410970
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAKQLIRLLLKTDPTERLTITQFMNHPWINQSMVVPQTPLHTARVLQEDKDHWDEVK

SEQ ID NO: 52658 - protein, 382 aa, Homo sapiens; identical to SEQ ID NO: 52653
  Payload ID: 10489
  Gene Symbol: MAPKAPK3
  Gene Name: mitogen-activated protein kinase-activated protein kinase 3
  Uniprot ID: Q16644
  ENSP ID: ENSP00000478922

SEQ ID NO: 52659 - protein, 74 aa, Homo sapiens
  Payload ID: 10490
  Gene Symbol: MAPKAPK5
  Gene Name: mitogen-activated protein kinase-activated protein kinase 5
  ENSP ID: ENSP00000448408
MSEESDMDKAIKDAPVKLCDFGFAKIDQGDLMTPQFTPYYVAPQVLEAQRRHQKEKSGIIPTSPTPYTYNKSSP

SEQ ID NO: 52660 - protein, 473 aa, Homo sapiens
  Payload ID: 10490
  Gene Symbol: MAPKAPK5
  Gene Name: mitogen-activated protein kinase-activated protein kinase 5
  Uniprot ID: Q8IW41
  ENSP ID: ENSP00000449381
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 52661 - protein, 471 aa, Homo sapiens
  Payload ID: 10490
  Gene Symbol: MAPKAPK5
  Gene Name: mitogen-activated protein kinase-activated protein kinase 5
  Uniprot ID: Q8IW41
  ENSP ID: ENSP00000449667
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGENEDEKLNEVMQEAWKYNRECKLLRDTLQSFSWNGRGFTDKVDRLKLAEIVKQVIEEQTTSHESQ

SEQ ID NO: 52662 - protein, 324 aa, Homo sapiens
  Payload ID: 10490
  Gene Symbol: MAPKAPK5
  Gene Name: mitogen-activated protein kinase-activated protein kinase 5
  ENSP ID: ENSP00000473467
MSEESDMDKAIKDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 52663 - protein, 51 aa, Homo sapiens
  Payload ID: 10490
  Gene Symbol: MAPKAPK5
  Gene Name: mitogen-activated protein kinase-activated protein kinase 5
  ENSP ID: ENSP00000473541
MSEESDMDKAIKAASICFRMVYRTWRVGIYPSLPICLKSAFWKSAVGKRKH

SEQ ID NO: 52664 - protein, 82 aa, Homo sapiens
  Payload ID: 10491
  Gene Symbol: MZT1
  Gene Name: mitotic spindle organizing protein 1
  Uniprot ID: Q08AG7
  ENSP ID: ENSP00000367049
MASSSGAGAAAAAAAANLNAVRETMDVLLEISRILNTGLDMETLSICVRLCEQGINPEALSSVIKELRKATEALKAAENMTS

SEQ ID NO: 52665 - protein, 158 aa, Homo sapiens
  Payload ID: 10492
  Gene Symbol: MZT2A
  Gene Name: mitotic spindle organizing protein 2A
  Uniprot ID: Q6P582
  ENSP ID: ENSP00000311500
MAAQGVGPGPGSAAPPGLEAARQKLALRRKKVLSTEEMELYELAQAAGGGIDPDVFKILVDLLKLNVAPLAVFQMLKSMCAGQRLASEPQDPAAVSLPTSSVPETRGRDKGSAALGGVLALAERSNHEGSSQRMPRQPSATRLPKGGGPGKSPTQGST

SEQ ID NO: 52666 - protein, 140 aa, Homo sapiens
  Payload ID: 10492
  Gene Symbol: MZT2A
  Gene Name: mitotic spindle organizing protein 2A
  ENSP ID: ENSP00000403353
  MOD_RES (1)..(1): Any amino acid
XPPGLEAARQKLALRRKKVLSTEEMELYELAQAAGGGIDPDVFKILVDLLKLNVAPLAVFQMLKSMCAGQRLASEPQDPAAVSLPTSSVPETRGLSDNLRTRRRLNKISHSSYGGQRSSTAWCGRRRRTCTSNWLKLQRH

SEQ ID NO: 52667 - protein, 158 aa, Homo sapiens
  Payload ID: 10493
  Gene Symbol: MZT2B
  Gene Name: mitotic spindle organizing protein 2B
  Uniprot ID: Q6NZ67
  ENSP ID: ENSP00000281871
MAAQGVGPGPGSAAPPGLEAARQKLALRRKKVLSTEEMELYELAQAAGGAIDPDVFKILVDLLKLNVAPLAVFQMLKSMCAGQRLASEPQDPAAVSLPTSSVPETRGRNKGSAALGGALALAERSSREGSSQRMPRQPSATRLPKGGGPGKSPTRGST

SEQ ID NO: 52668 - protein, 218 aa, Homo sapiens
  Payload ID: 10493
  Gene Symbol: MZT2B
  Gene Name: mitotic spindle organizing protein 2B
  ENSP ID: ENSP00000386419
MAAQGVGPGPGSAAPPGLEAARQKLALRRKKVLSTEEMELYELAQAAGGAIDPDVFKILVDLLKLNVAPLAVFQMLKSMCAGQRLASEPQDPAAVSLPTSSVPETREASFLSARNSSPPARPSFSSSPQPAASPVLLHSPAATHSPLSPGPPGSLRLSCCLFSPFAGRNKGSAALGGALALAERSSREGSSQRMPRQPSATRLPKGGGPGKSPTRGST

SEQ ID NO: 52669 - protein, 121 aa, Homo sapiens
  Payload ID: 10493
  Gene Symbol: MZT2B
  Gene Name: mitotic spindle organizing protein 2B
  ENSP ID: ENSP00000387805
VVAASGAPRYFLPSKESACAILVDLLKLNVAPLAVFQMLKSMCAGQRLASEPQDPAAVSLPTSSVPETRGRNKGSAALGGALALAERSSREGSSQRMPRQPSATRLPKGGGPGKSPTRGST

SEQ ID NO: 52670 - protein, 122 aa, Homo sapiens
  Payload ID: 10493
  Gene Symbol: MZT2B
  Gene Name: mitotic spindle organizing protein 2B
  ENSP ID: ENSP00000398749
  MOD_RES (1)..(1): Any amino acid
XGREWSLAECACVVAASGAPRILVDLLKLNVAPLAVFQMLKSMCAGQRLASEPQDPAAVSLPTSSVPETRGRNKGSAALGGALALAERSSREGSSQRMPRQPSATRLPKGGGPGKSPTRGST

SEQ ID NO: 52671 - protein, 120 aa, Homo sapiens
  Payload ID: 10493
  Gene Symbol: MZT2B
  Gene Name: mitotic spindle organizing protein 2B
  ENSP ID: ENSP00000404629
GSAAPPGLEAARQKLALRRKKVLSTEEMELYELAQAAGGAIDPDVFKEKQRQRCPRGSIGPGGTQQPRRIQPEDATPAQRYQAAQGGRAWEEPYTGQHLGWGRDLLHLCPQQRLHVTSFN

SEQ ID NO: 52672 - protein, 679 aa, Homo sapiens
  Payload ID: 10494
  Gene Symbol: MISP
  Gene Name: mitotic spindle positioning
  Uniprot ID: Q8IVT2
  ENSP ID: ENSP00000215582
MDRVTRYPILGIPQAHRGTGLVLDGDTSYTYHLVCMGPEASGWGQDEPQTWPTDHRAQQGVQRQGVSYSVHAYTGQPSPRGLHSENREDEGWQVYRLGARDAHQGRPTWALRPEDGEDKEMKTYRLDAGDADPRRLCDLERERWAVIQGQAVRKSSTVATLQGTPDHGDPRTPGPPRSTPLEENVVDREQIDFLAARQQFLSLEQANKGAPHSSPARGTPAGTTPGASQAPKAFNKPHLANGHVVPIKPQVKGVVREENKVRAVPTWASVQVVDDPGSLASVESPGTPKETPIEREIRLAQEREADLREQRGLRQATDHQELVEIPTRPLLTKLSLITAPRRERGRPSLYVQRDIVQETQREEDHRREGLHVGRASTPDWVSEGPQPGLRRALSSDSILSPAPDARAADPAPEVRKVNRIPPDAYQPYLSPGTPQLEFSAFGAFGKPSSLSTAEAKAATSPKATMSPRHLSESSGKPLSTKQEASKPPRGCPQANRGVVRWEYFRLRPLRFRAPDEPQQAQVPHVWGWEVAGAPALRLQKSQSSDLLERERESVLRREQEVAEERRNALFPEVFSPTPDENSDQNSRSSSQASGITGSYSVSESPFFSPIHLHSNVAWTVEDPVDSAPPGQRKKEQWYAGINPSDGINSEVLEAIRVTRHKNAMAERWESRIYASEEDD

SEQ ID NO: 52673 - protein, 232 aa, Homo sapiens
  Payload ID: 10495
  Gene Symbol: MIXL1
  Gene Name: Mix paired-like homeobox
  Uniprot ID: Q9H2W2
  ENSP ID: ENSP00000355775
MATAESRALQFAEGAAFPAYRAPHAGGALLPPPSPAAALLPAPPAGPGPATFAGFLGRDPGPAPPPPASLGSPAPPKGAAAPSASQRRKRTSFSAEQLQLLELVFRRTRYPDIHLRERLAALTLLPESRIQVWFQNRRAKSRRQSGKSFQPLARPEIILNHCAPGTETKCLKPQLPLEVDVNCLPEPNGVGGGISDSSSQGQNFETCSPLSEDIGSKLDSWEEHIFSAFGNF

SEQ ID NO: 52674 - protein, 240 aa, Homo sapiens
  Payload ID: 10495
  Gene Symbol: MIXL1
  Gene Name: Mix paired-like homeobox
  Uniprot ID: Q9H2W2
  ENSP ID: ENSP00000442439
MATAESRALQFAEGAAFPAYRAPHAGGALLPPPSPAAALLPAPPAGPGPATFAGFLGRDPGPAPPPPASLGSPAPPKGAAAPSASQRRKRTSFSAEQLQLLELVFRRTRYPDIHLRERLAALTLLPESRIQLLFSPLFQVWFQNRRAKSRRQSGKSFQPLARPEIILNHCAPGTETKCLKPQLPLEVDVNCLPEPNGVGGGISDSSSQGQNFETCSPLSEDIGSKLDSWEEHIFSAFGNF

SEQ ID NO: 52675 - protein, 263 aa, Homo sapiens
  Payload ID: 10496
  Gene Symbol: MLKL
  Gene Name: mixed lineage kinase domain-like
  Uniprot ID: Q8NB16
  ENSP ID: ENSP00000303118
MENLKHIITLGQVIHKRCEEMKYCKKQCRRLGHRVLGLIKPLEMLQDQGKRSVPSEKLTTAMNRFKAALEEANGEIEKFSNRSNICRFLTASQDKILFKDVNRKLSDVWKELSLLLQVEQRMPVSPISQGASWAQEDQQDADEDRRAFQMLRRDNEKIEASLRRLEINMKEIKETLRQSLESSSGKSPLEISRFKVKNVKTGSASGCNSEKIRKLVAVKRQQEPLGEDCPSELREIIDECRAHDPSVRPSVDEILKKLSTFSK

SEQ ID NO: 52676 - protein, 471 aa, Homo sapiens
  Payload ID: 10496
  Gene Symbol: MLKL
  Gene Name: mixed lineage kinase domain-like
  Uniprot ID: Q8NB16
  ENSP ID: ENSP00000308351
MENLKHIITLGQVIHKRCEEMKYCKKQCRRLGHRVLGLIKPLEMLQDQGKRSVPSEKLTTAMNRFKAALEEANGEIEKFSNRSNICRFLTASQDKILFKDVNRKLSDVWKELSLLLQVEQRMPVSPISQGASWAQEDQQDADEDRRAFQMLRRDNEKIEASLRRLEINMKEIKETLRQYLPPKCMQEIPQEQIKEIKKEQLSGSPWILLRENEVSTLYKGEYHRAPVAIKVFKKLQAGSIAIVRQTFNKEIKTMKKFESPNILRIFGICIDETVTPPQFSIVMEYCELGTLRELLDREKDLTLGKRMVLVLGAARGLYRLHHSEAPELHGKIRSSNFLVTQGYQVKLAGFELRKTQTSMSLGTTREKTDRVKSTAYLSPQELEDVFYQYDVKSEIYSFGIVLWEIATGDIPFQGCNSEKIRKLVAVKRQQEPLGEDCPSELREIIDECRAHDPSVRPSVDEILKKLSTFSK

SEQ ID NO: 52677 - protein, 211 aa, Homo sapiens
  Payload ID: 10496
  Gene Symbol: MLKL
  Gene Name: mixed lineage kinase domain-like
  ENSP ID: ENSP00000459920
MENLKHIITLGQVIHKRCEEMKYCKKQCRRLGHRVLGLIKPLEMLQDQGKRSVPSEKLTTAMNRFKAALEEANGEIEKFSNRSNICRFLTASQDKILFKDVNRKLSDVWKELSLLLQVEQRMPVSPISQGASWAQEDQQDADEDRRAFQMLRRDNEKIEASLRRLEINMKEIKETLRQYLPPKCMQEIPQEQIKEIKKEQLSGSPWILLRE

SEQ ID NO: 52678 - protein, 102 aa, Homo sapiens
  Payload ID: 10496
  Gene Symbol: MLKL
  Gene Name: mixed lineage kinase domain-like
  ENSP ID: ENSP00000459935
  MOD_RES (1)..(1): Any amino acid
XKNQKLKLPGNSRLPSEALESSSGKSPLEISRFKVKNVKTGSASGCNSEKIRKLVAVKRQQEPLGEDCPSELREIIDECRAHDPSVRPSVDEILKKLSTFSK

SEQ ID NO: 52679 - protein, 175 aa, Homo sapiens
  Payload ID: 10496
  Gene Symbol: MLKL
  Gene Name: mixed lineage kinase domain-like
  ENSP ID: ENSP00000461110
  MOD_RES (1)..(1): Any amino acid
XSDLPPKCMQEIPQEQIKEIKKEQLSGSPWILLRENEVSTLYKGEYHRAPVAIKVFKKLQAGSIAIVRQTFNKEIKTMKKFESPNILRIFGICIDETVTPPQFSIVMEYCELGTLRELLDREKDLTLGKRMVLVLGAARGLYRLHHSEAPELHGKIRSSNFLVTQGYQVKIWVPG

SEQ ID NO: 52680 - protein, 62 aa, Homo sapiens
  Payload ID: 10496
  Gene Symbol: MLKL
  Gene Name: mixed lineage kinase domain-like
  ENSP ID: ENSP00000461666
MKYCKKQCRRLGHRVLGLIKPLEMLQDQGKRSVPSEKLTTAMNRFKAALEEANGEIEKFSNR

SEQ ID NO: 52681 - protein, 1049 aa, Homo sapiens
  Payload ID: 10497
  Gene Symbol: MKL2
  Gene Name: MKL/myocardin-like 2
  Uniprot ID: Q9ULH7
  ENSP ID: ENSP00000339086
MDHTGAIDTEDEVGPLAHLAPSPQSEAVAHEFQELSLQSSQNLPPLNERKNVLQLRLQQRRTREQLVDQGIMPPLKSPAAFHEQIKSLERARTENFLKHKIRSRPDRSELVRMHILEETFAEPSLQATQMKLKRARLADDLNEKIAQRPGPMELVEKNILPVDSSVKEAIIGVGKEDYPHTQGDFSFDEDSSDALSPDQPASQESQGSAASPSEPKVSESPSPVTTNTPAQFASVSPTVPEFLKTPPTADQPPPRPAAPVLPTNTVSSAKPGPALVKQSHPKNPNDKHRSKKCKDPKPRVKKLKYHQYIPPDQKGEKNEPQMDSNYARLLQQQQLFLQLQILSQQKQHYNYQTILPAPFKPLNDKNSNSGNSALNNATPNTPRQNTSTPVRKPGPLPSSLDDLKVSELKTELKLRGLPVSGTKPDLIERLKPYQEVNSSGLAAGGIVAVSSSAIVTSNPEVTVALPVTTLHNTVTSSVSTLKAELPPTGTSNATRVENVHSPLPISPSPSEQSSLSTDDTNMADTFTEIMTMMSPSQFLSSSPLRMTNNEDSLSPTSSTLSNLELDAAEKDRKLQEKEKQIEELKRKLEQEQKLVEVLKMQLEVEKRGQQQRPLEAQPSAPGHSVKSDQKHGSLGSSIKDEASLPDCSSSRQPIPVASHAVGQPVSTGGQTLVAKKAVVIKQEVPVGQAEQQSVVSQFYTSPQAGMQTQPQIATAAQIPTAALASGLAPTVPQTQDTFPQHVLSQPQQVRKVFTNSASSNTVLPYQRHPAPAVQQPFINKASNSVLQSRNAPLPSLQNGPNTPNKPSSPPPPQQFVVQHSLFGSPVAKTKDPPRYEEAIKQTRSTQAPLPEISNAHSQQMDDLFDILIKSGEISLPIKEEPSPISKMRPVTASITTMPVNTVVSRPPPQVQMAPPVSLEPMGSLSASLENQLEAFLDGTLPSANEIPPLQSSSEDREPFSLIEDLQNDLLSHSGMLDHSHSPMETSETQFAAGTPCLSLDLSDSNLDNMEWLDITMPNSSSGLTPLSTTAPSMFSADFLDPQDLPLPWD

SEQ ID NO: 52682 - protein, 70 aa, Homo sapiens
  Payload ID: 10497
  Gene Symbol: MKL2
  Gene Name: MKL/myocardin-like 2
  ENSP ID: ENSP00000458340
MDHTGAIDTEDEVGPLAHLAPSPQSEAVAHEFQELSLQSSQNLPPLNERKNVLQLRLQQRRTREQLVDQG

SEQ ID NO: 52683 - protein, 1049 aa, Homo sapiens; identical to SEQ ID NO: 52681
  Payload ID: 10497
  Gene Symbol: MKL2
  Gene Name: MKL/myocardin-like 2
  Uniprot ID: Q9ULH7
  ENSP ID: ENSP00000459205

SEQ ID NO: 52684 - protein, 191 aa, Homo sapiens
  Payload ID: 10497
  Gene Symbol: MKL2
  Gene Name: MKL/myocardin-like 2
  ENSP ID: ENSP00000459518
  MOD_RES (1)..(1): Any amino acid
XMDDLFDILIKSGEISLPIKEEPSPISKMRPVTASITTMPVNTVVSRPPPQVQMAPPVSLEPMGSLSASLENQLEAFLDGTLPSANEIPPLQSSSEDREPFSLIEDLQNDLLSHSGMLDHSHSPMETSETQFAAGTPCLSLDLSDSNLDNMEWLDITMPNSSSGLTPLSTTAPSMFSADFLDPQDLPLPWD

SEQ ID NO: 52685 - protein, 1099 aa, Homo sapiens
  Payload ID: 10497
  Gene Symbol: MKL2
  Gene Name: MKL/myocardin-like 2
  Uniprot ID: Q9ULH7
  ENSP ID: ENSP00000459626
MDHTGAIDTEDEVGPLAHLAPSPQSEAVAHEFQELSLQSSQNLPPLNERKNVLQLRLQQRRTREQLVDQGIMPPLKSPAAFHEQIKSLERARTENFLKHKIRSRPDRSELVRMHILEETFAEPSLQATQMKLKRARLADDLNEKIAQRPGPMELVEKNILPVDSSVKEAIIGVGKEDYPHTQGDFSFDEDSSDALSPDQPASQESQGSAASPSEPKVSESPSPVTTNTPAQFASVSPTVPEFLKTPPTADQPPPRPAAPVLPTNTVSSAKPGPALVKQSHPKNPNDKHRSKKCKDPKPRVKKLKYHQYIPPDQKGEKNEPQMDSNYARLLQQQQLFLQLQILSQQKQHYNYQTILPAPFKPLNDKNSNSGNSALNNATPNTPRQNTSTPVRKPGPLPSSLDDLKVSELKTELKLRGLPVSGTKPDLIERLKPYQEVNSSGLAAGGIVAVSSSAIVTSNPEVTVALPVTTLHNTVTSSVSTLKAELPPTGTSNATRVENVHSPLPISPSPSEQSSLSTDDTNMADTFTEIMTMMSPSQFLSSSPLRMTNNEDSLSPTSSTLSNLELDAAEKDRKLQEKEKQIEELKRKLEQEQKLVEVLKMQLEVEKRGQQQRPLEAQPSAPGHSVKSDQKHGSLGSSIKDEASLPDCSSSRQPIPVASHAVGQPVSTGGQTLVAKKAVVIKQEVPVGQAEQQSVVSQFYVSSQGQPPPAVVAQPQALLTTQTAQLLLPVSIQGSSVTSVQLPVGSLKLQTSPQAGMQTQPQIATAAQIPTAALASGLAPTVPQTQDTFPQHVLSQPQQVRKVFTNSASSNTVLPYQRHPAPAVQQPFINKASNSVLQSRNAPLPSLQNGPNTPNKPSSPPPPQQFVVQHSLFGSPVAKTKDPPRYEEAIKQTRSTQAPLPEISNAHSQQMDDLFDILIKSGEISLPIKEEPSPISKMRPVTASITTMPVNTVVSRPPPQVQMAPPVSLEPMGSLSASLENQLEAFLDGTLPSANEIPPLQSSSEDREPFSLIEDLQNDLLSHSGMLDHSHSPMETSETQFAAGTPCLSLDLSDSNLDNMEWLDITMPNSSSGLTPLSTTAPSMFSADFLDPQDLPLPWD

SEQ ID NO: 52686 - protein, 369 aa, Homo sapiens
  Payload ID: 10497
  Gene Symbol: MKL2
  Gene Name: MKL/myocardin-like 2
  ENSP ID: ENSP00000459879
MIDSSKKQQQGFPEILTAGDFEPLKEKECLEGSNQKSLKEVLQLRLQQRRTREQLVDQGIMPPLKSPAAFHEQIKSLERARTENFLKHKIRSRPDRSELVRMHILEETFAEPSLQATQMKLKRARLADDLNEKIAQRPGPMELVEKNILPVDSSVKEAIIGVGKEDYPHTQGDFSFDEDSSDALSPDQPASQESQGSAASPSEPKVSESPSPVTTNTPAQFASVSPTVPEFLKTPPTADQPPPRPAAPVLPTNTVSSAKPGPALVKQSHPKNPNDKHRSKKCKDPKPRVKKLKYHQYIPPDQKGEKNEPQMDSNYARLLQQQQLFLQLQILSQQKQHYNYQTILPAPFKYGGAHAILNAGFSVVFYEEL

SEQ ID NO: 52687 - protein, 378 aa, Homo sapiens
  Payload ID: 10497
  Gene Symbol: MKL2
  Gene Name: MKL/myocardin-like 2
  Uniprot ID: Q9ULH7
  ENSP ID: ENSP00000460589
MLQLRLQQRRTREQLVDQGIMPPLKSPAAFHEQIKSLERARTENFLKHKIRSRPDRSELVRMHILEETFAEPSLQATQMKLKRARLADDLNEKIAQRPGPMELVEKNILPVDSSVKEAIIGVGKEDYPHTQGDFSFDEDSSDALSPDQPASQESQGSAASPSEPKVSESPSPVTTNTPAQFASVSPTVPEFLKTPPTADQPPPRPAAPVLPTNTVSSAKPGPALVKQSHPKNPNDKHRSKKCKDPKPRVKKLKYHQYIPPDQKGEKNEPQMDSNYARLLQQQQLFLQLQILSQQKQHYNYQTILPAPFKAYHTVSEVHMVRVACIPFQFLSSKIGSEFLQVRNAFSQLFIQICLLLEHQNSTRCSEKSVSSIIPGINS

SEQ ID NO: 52688 - protein, 52 aa, Homo sapiens
  Payload ID: 10497
  Gene Symbol: MKL2
  Gene Name: MKL/myocardin-like 2
  ENSP ID: ENSP00000460848
IDTEDEVGPLAHLAPSPQSEAVAHEFQELSLQSSQNLPPLNERKNVNIPPCY

SEQ ID NO: 52689 - protein, 223 aa, Homo sapiens
  Payload ID: 10498
  Gene Symbol: MKRN2OS
  Gene Name: MKRN2 opposite strand
  Uniprot ID: H3BPM6
  ENSP ID: ENSP00000455385
MHCAEAGKALIKFNHCEKYIYSFSVPQCCPLCQQDLGSRKLEDAPVSIANPFTNGHQEKCSFLLRPTQGTFLREYDGRSDLHVGITNTNGVVYNYSAHGVQRDGEGWEESISIPLLQPNMYGMMEQWDKYLEDFSTSGAWLPHRYEDNHHNCYSYALTFINCVLMAEGRQQLDKGEFTEKYVVPRTRLASKFITLYRAIREHGFYVTDCPQQQAQPPEGGGLC

SEQ ID NO: 52690 - protein, 76 aa, Homo sapiens
  Payload ID: 10498
  Gene Symbol: MKRN2OS
  Gene Name: MKRN2 opposite strand
  ENSP ID: ENSP00000456723
MHCAEAGKALIKFNHCEKYIYSFSVPQCCPLCQQDLGSRKLEDAPVSIANPFTNGHQEKCSFLLRPTQGTFLRGCV

SEQ ID NO: 52691 - protein, 919 aa, Homo sapiens
  Payload ID: 10499
  Gene Symbol: MLXIP
  Gene Name: MLX interacting protein
  Uniprot ID: Q9HAP2
  ENSP ID: ENSP00000312834
MAADVFMCSPRRPRSRGRQVLLKPQVSEDDDDSDTDEPSPPPASGAATPARAHASAAPPPPRAGPGREEPPRRQQIIHSGHFMVSSPHREHPPKKGYDFDTVNKQTCQTYSFGKTSSCHLSIDASLTKLFECMTLAYSGKLVSPKWKNFKGLKLQWRDKIRLNNAIWRAWYMQYLEKRKNPVCHFVTPLDGSVDVDEHRRPEAITTEGKYWKSRIEIVIREYHKWRTYFKKRLQQHKDEDLSSLVQDDDMLYWHKHGDGWKTPVPMEEDPLLDTDMLMSEFSDTLFSTLSSHQPVAWPNPREIAHLGNADMIQPGLIPLQPNLDFMDTFEPFQDLFSSSRSIFGSMLPASASAPVPDPNNPPAQESILPTTALPTVSLPDSLIAPPTAPSLAHMDEQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 52692 - protein, 217 aa, Homo sapiens
  Payload ID: 10499
  Gene Symbol: MLXIP
  Gene Name: MLX interacting protein
  Uniprot ID: Q9HAP2
  ENSP ID: ENSP00000366236
MDEQGCEHTSRTEDPFIQPTDFGPSEPPLSVPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPGEPGGETQCGAPPDPEGCFPIPKAFKLVTTTTTLVCTCMRTHIHLNETKVS

SEQ ID NO: 52693 - protein, 73 aa, Homo sapiens
  Payload ID: 10499
  Gene Symbol: MLXIP
  Gene Name: MLX interacting protein
  ENSP ID: ENSP00000438206
MLYWHKHGDGWKTPVPMEEDPLLDTDMLMSEFSDTLFSTLSSHQPVAWPNPREIAHLGNADMIQPGLIPLQPN

SEQ ID NO: 52694 - protein, 526 aa, Homo sapiens
  Payload ID: 10499
  Gene Symbol: MLXIP
  Gene Name: MLX interacting protein
  Uniprot ID: Q9HAP2
  ENSP ID: ENSP00000440769
MDEQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 52695 - protein, 171 aa, Homo sapiens
  Payload ID: 10499
  Gene Symbol: MLXIP
  Gene Name: MLX interacting protein
  ENSP ID: ENSP00000444507
  MOD_RES (1)..(1): Any amino acid
XHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIIDPFSVGRYFPAPGERSTPVQPPSGLQSPAPLRACLFFNHT

SEQ ID NO: 52696 - protein, 308 aa, Homo sapiens
  Payload ID: 10499
  Gene Symbol: MLXIP
  Gene Name: MLX interacting protein
  ENSP ID: ENSP00000445891
MVLGALVALSSCPLGLRTSCLTGREAASAGWARPCGPGLHLNILLILAAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIV

SEQ ID NO: 52697 - protein, 217 aa, Homo sapiens; identical to SEQ ID NO: 52692
  Payload ID: 10499
  Gene Symbol: MLXIP
  Gene Name: MLX interacting protein
  ENSP ID: ENSP00000486016

SEQ ID NO: 52698 - protein, 171 aa, Homo sapiens; identical to SEQ ID NO: 52695
  Payload ID: 10499
  Gene Symbol: MLXIP
  Gene Name: MLX interacting protein
  ENSP ID: ENSP00000486259
  MOD_RES (1)..(1): Any amino acid

SEQ ID NO: 52699 - protein, 308 aa, Homo sapiens; identical to SEQ ID NO: 52696
  Payload ID: 10499
  Gene Symbol: MLXIP
  Gene Name: MLX interacting protein
  ENSP ID: ENSP00000486484

SEQ ID NO: 52700 - protein, 526 aa, Homo sapiens; identical to SEQ ID NO: 52694
  Payload ID: 10499
  Gene Symbol: MLXIP
  Gene Name: MLX interacting protein
  ENSP ID: ENSP00000486569

SEQ ID NO: 52701 - protein, 73 aa, Homo sapiens; identical to SEQ ID NO: 52693
  Payload ID: 10499
  Gene Symbol: MLXIP
  Gene Name: MLX interacting protein
  ENSP ID: ENSP00000486990

SEQ ID NO: 52702 - protein, 919 aa, Homo sapiens; identical to SEQ ID NO: 52691
  Payload ID: 10499
  Gene Symbol: MLXIP
  Gene Name: MLX interacting protein
  ENSP ID: ENSP00000487003

SEQ ID NO: 52703 - protein, 852 aa, Homo sapiens
  Payload ID: 10500
  Gene Symbol: MLXIPL
  Gene Name: MLX interacting protein-like
  Uniprot ID: Q9NP71
  ENSP ID: ENSP00000320886
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 52704 - protein, 575 aa, Homo sapiens
  Payload ID: 10500
  Gene Symbol: MLXIPL
  Gene Name: MLX interacting protein-like
  Uniprot ID: Q9NP71
  ENSP ID: ENSP00000343767
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPAVNGGCQGTSAPCQALGL

SEQ ID NO: 52705 - protein, 831 aa, Homo sapiens
  Payload ID: 10500
  Gene Symbol: MLXIPL
  Gene Name: MLX interacting protein-like
  Uniprot ID: Q9NP71
  ENSP ID: ENSP00000346629
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKNRRITHISAEQKRRFNIKLGFDTLHGLVSTLSAQPSLKERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 52706 - protein, 721 aa, Homo sapiens
  Payload ID: 10500
  Gene Symbol: MLXIPL
  Gene Name: MLX interacting protein-like
  ENSP ID: ENSP00000392636
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIELPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPST

SEQ ID NO: 52707 - protein, 213 aa, Homo sapiens
  Payload ID: 10500
  Gene Symbol: MLXIPL
  Gene Name: MLX interacting protein-like
  ENSP ID: ENSP00000395172
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYFFTNSRLPQPPMPSNFPEPPSFSPVVDSLFSSGTLGPEVPPASSAMTHLSGHSRLQARNSCPGPLDSSAFLSSDFLLPE

SEQ ID NO: 52708 - protein, 235 aa, Homo sapiens
  Payload ID: 10500
  Gene Symbol: MLXIPL
  Gene Name: MLX interacting protein-like
  ENSP ID: ENSP00000402615
PKWKNFKGLKLLCRDKIRLNNAIWRAWYIQYVKRRKSPVCGFVTPLQGPEADAHRKPEAVVLEGNYWKRRIEVVMREYHKWRIYYKKRVSGGGPGRPQSFPPAAAGYRPPRKIPGKGILTPELAPLGPSIQSRADSATVWPQRLLAASLPRGRLRKPSREDDLLAPKQAEGRWPPPEQWCKQLFSSVVPVLLGDPEEEPGGRQLLDLNCFLSDISDTLFTMTQSGPSPLQLPPED

SEQ ID NO: 52709 - protein, 833 aa, Homo sapiens
  Payload ID: 10500
  Gene Symbol: MLXIPL
  Gene Name: MLX interacting protein-like
  Uniprot ID: Q9NP71
  ENSP ID: ENSP00000406296
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 52710 - protein, 850 aa, Homo sapiens
  Payload ID: 10500
  Gene Symbol: MLXIPL
  Gene Name: MLX interacting protein-like
  Uniprot ID: Q9NP71
  ENSP ID: ENSP00000412330
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKNRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 52711 - protein, 298 aa, Homo sapiens
  Payload ID: 10501
  Gene Symbol: MLX
  Gene Name: MLX, MAX dimerization protein
  Uniprot ID: Q9UH92
  ENSP ID: ENSP00000246912
MTEPGASPEDPWVKASPVGAHAGEGRAGRARARRGAGRRGASLLSPKSPTLSVPRGCREDSSHPACAKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 52712 - protein, 214 aa, Homo sapiens
  Payload ID: 10501
  Gene Symbol: MLX
  Gene Name: MLX, MAX dimerization protein
  Uniprot ID: Q9UH92
  ENSP ID: ENSP00000320913
MTEPGASPEDPWVKVEYAYSDNSLDPDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 52713 - protein, 244 aa, Homo sapiens
  Payload ID: 10501
  Gene Symbol: MLX
  Gene Name: MLX, MAX dimerization protein
  Uniprot ID: Q9UH92
  ENSP ID: ENSP00000416627
MTEPGASPEDPWVKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 52714 - protein, 248 aa, Homo sapiens
  Payload ID: 10501
  Gene Symbol: MLX
  Gene Name: MLX, MAX dimerization protein
  ENSP ID: ENSP00000464697
MTEPGASPEDPWVKASPVGAHAGEGRAGRARARRGAGRRGASLLSPKSPTLSVPRGCREDSSHPACAKVEYAYSDNSLDPDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCK

SEQ ID NO: 52715 - protein, 71 aa, Homo sapiens
  Payload ID: 10502
  Gene Symbol: MMP24-AS1
  Gene Name: MMP24 antisense RNA 1
  ENSP ID: ENSP00000488948
MGAQLSGGRGAPEPAQTQPQPQPQPAAPEGPEQPRHPPQPQPQPQPQPQPEPSPWGPLDDVRFLIACTSWY

SEQ ID NO: 52716 - protein, 71 aa, Homo sapiens; identical to SEQ ID NO: 52715
  Payload ID: 10502
  Gene Symbol: MMP24-AS1
  Gene Name: MMP24 antisense RNA 1
  ENSP ID: ENSP00000489182

SEQ ID NO: 52717 - protein, 71 aa, Homo sapiens; identical to SEQ ID NO: 52715
  Payload ID: 10502
  Gene Symbol: MMP24-AS1
  Gene Name: MMP24 antisense RNA 1
  ENSP ID: ENSP00000489588

SEQ ID NO: 52718 - protein, 932 aa, Homo sapiens
  Payload ID: 10503
  Gene Symbol: MMS19
  Gene Name: MMS19 homolog, cytosolic iron-sulfur assembly component
  Uniprot ID: Q96T76
  ENSP ID: ENSP00000320059
MAAAAAVEAAAPMGALWGLVHDFVVGQQEGPADQVAADVKSGNYTVLQVVEALGSSLENPEPRTRARAIQLLSQVLLHCHTLLLEKEVVHLILFYENRLKDHHLVIPSVLQGLKALSLCVALPPGLAVSVLKAIFQEVHVQSLPQVDRHTVYNIITNFMRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRRESSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 52719 - protein, 987 aa, Homo sapiens
  Payload ID: 10503
  Gene Symbol: MMS19
  Gene Name: MMS19 homolog, cytosolic iron-sulfur assembly component
  Uniprot ID: Q96T76
  ENSP ID: ENSP00000348097
MAAAAAVEAAAPMGALWGLVHDFVVGQQEGPADQVAADVKSGNYTVLQVVEALGSSLENPEPRTRARAIQLLSQVLLHCHTLLLEKEVVHLILFYENRLKDHHLVIPSVLQGLKALSLCVALPPGLAVSVLKAIFQEVHVQSLPQVDRHTVYNIITNFMRTREEGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 52720 - protein, 1030 aa, Homo sapiens
  Payload ID: 10503
  Gene Symbol: MMS19
  Gene Name: MMS19 homolog, cytosolic iron-sulfur assembly component
  Uniprot ID: Q96T76
  ENSP ID: ENSP00000359818
MAAAAAVEAAAPMGALWGLVHDFVVGQQEGPADQVAADVKSGNYTVLQVVEALGSSLENPEPRTRARAIQLLSQVLLHCHTLLLEKEVVHLILFYENRLKDHHLVIPSVLQGLKALSLCVALPPGLAVSVLKAIFQEVHVQSLPQVDRHTVYNIITNFMRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 52721 - protein, 277 aa, Homo sapiens
  Payload ID: 10503
  Gene Symbol: MMS19
  Gene Name: MMS19 homolog, cytosolic iron-sulfur assembly component
  ENSP ID: ENSP00000391765
MAAAAAVEAAAPMGALWGLVHDFVVGQQEGPADQVAADVKSGNYTVLQVVEALGSSLENPEPRTRARAIQLLSQVLLHCHTLLLEKEGAESLIGKKEGRRKKLPCTETERGSKAKRGNSACHRYQLVVHLILFYENRLKDHHLVIPSVLQGLKALSLCVALPPGLAVSVLKAIFQEVHVQSLPQVDRHTVYNIITNFMRTREEELKSLGADFTFGFIQVMDGEKDPRNLLVAFRIVHDLISRDYSLGPFVEELFEVTSCYFPIDFTPPPNDPHGIQR

SEQ ID NO: 52722 - protein, 98 aa, Homo sapiens
  Payload ID: 10503
  Gene Symbol: MMS19
  Gene Name: MMS19 homolog, cytosolic iron-sulfur assembly component
  ENSP ID: ENSP00000393929
AAAAVEAAAPMGALWGLVHDFVVGQQEGPADQVAADVKSGNYTVLQVVEALGSSLENPEPRTRARAIQLLSQVLLHCHTLLLEKEGTGVTNRNVFLDC

SEQ ID NO: 52723 - protein, 40 aa, Homo sapiens
  Payload ID: 10503
  Gene Symbol: MMS19
  Gene Name: MMS19 homolog, cytosolic iron-sulfur assembly component
  Uniprot ID: Q96T76
  ENSP ID: ENSP00000395045
MAAAAAVEAAAPMGALWGLVHDFVVGQQEGPADQVAAGPL

SEQ ID NO: 52724 - protein, 173 aa, Homo sapiens
  Payload ID: 10503
  Gene Symbol: MMS19
  Gene Name: MMS19 homolog, cytosolic iron-sulfur assembly component
  ENSP ID: ENSP00000400028
MAAAAAVEAAAPMGALWGLVHDFVVGQQEGPADQVAADVKSGNYTVLQVVEALGSSLENPEPRTRARAIQLLSQVLLHCHTLLLEKEVVHLILFYENRLKDHHLVIPSVLQGLKALSLCVALPPGLAVSVLKAIFQEVHVQSLPQVDRHTVYNIITNFMRTREEGDGWGKGSP

SEQ ID NO: 52725 - protein, 149 aa, Homo sapiens
  Payload ID: 10503
  Gene Symbol: MMS19
  Gene Name: MMS19 homolog, cytosolic iron-sulfur assembly component
  ENSP ID: ENSP00000402819
LQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQYPLKRYRAASGGQSLKCSWVS

SEQ ID NO: 52726 - protein, 302 aa, Homo sapiens
  Payload ID: 10503
  Gene Symbol: MMS19
  Gene Name: MMS19 homolog, cytosolic iron-sulfur assembly component
  ENSP ID: ENSP00000409425
MAAAAAVEAAAPMGALWGLVHDFVVGQQEGPADQVAADVKSGNYTVLQVVEALGSSLENPEPRTRARAIQLLSQVLLHCHTLLLEKEVVHLILFYENRLKDHHLVIPSVLQGLKALSLCVALPPGLAVSVLKAIFQEVHVQSLPQVDRHTVYNIITNFMRTREEELKSLGADFTFGFIQVMDGEKDPRNLLVAFRIVHDLISRDYSLGPFVEELFEVTSCYFPIDFTPREDLILSLRAVLASTPRFAEFLLPLLIEKVDSEVLSAKLDSLQTLNACCAVYGQKELKDFLPSLWASIRREVFQ

SEQ ID NO: 52727 - protein, 598 aa, Homo sapiens
  Payload ID: 10503
  Gene Symbol: MMS19
  Gene Name: MMS19 homolog, cytosolic iron-sulfur assembly component
  ENSP ID: ENSP00000410008
  MOD_RES (1)..(1): Any amino acid
XWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 52728 - protein, 1030 aa, Homo sapiens; identical to SEQ ID NO: 52720
  Payload ID: 10503
  Gene Symbol: MMS19
  Gene Name: MMS19 homolog, cytosolic iron-sulfur assembly component
  Uniprot ID: Q96T76
  ENSP ID: ENSP00000412698

SEQ ID NO: 52729 - protein, 40 aa, Homo sapiens; identical to SEQ ID NO: 52723
  Payload ID: 10503
  Gene Symbol: MMS19
  Gene Name: MMS19 homolog, cytosolic iron-sulfur assembly component
  Uniprot ID: Q96T76
  ENSP ID: ENSP00000413801

SEQ ID NO: 52730 - protein, 90 aa, Homo sapiens
  Payload ID: 10503
  Gene Symbol: MMS19
  Gene Name: MMS19 homolog, cytosolic iron-sulfur assembly component
  ENSP ID: ENSP00000415326
  MOD_RES (1)..(1): Any amino acid
XVKPNYLKGLSHVLNRLPKPVLLPELPTAVRIAALQCMHALTRLPTPVLLPYKPQVIRALAKPLDDKKRLVRKEAVSARGEWFLLGSPGS

SEQ ID NO: 52731 - protein, 1243 aa, Homo sapiens
  Payload ID: 10504
  Gene Symbol: MMS22L
  Gene Name: MMS22-like, DNA repair protein
  Uniprot ID: Q6ZRQ5
  ENSP ID: ENSP00000275053
MENCSAASTFLTDSLELELGTEWCKPPYFSCAVDNRGGGKHFSGESYLCSGALKRLILNLDPLPTNFEEDTLEIFGIQWVTETALVNSSRELFHLFRQQLYNLETLLQSSCDFGKVSTLHCKADNIRQQCVLFLHYVKVFIFRYLKVQNAESHVPVHPYEALEAQLPSVLIDELHGLLLYIGHLSELPSVNIGAFVNQNQIKLFPPSWHLLHLHLDIHWLVLEILYMLGEKLKQVVYGHQFMNLASDNLTNISLFEEHCETLLCDLISLSLNRYDKVRSSESLMSDQCPCLCIKELWVLLIHLLDHRSKWFVSESFWNWLNKLLKTLLEKSSDRRRSSMPVIQSRDPLGFSWWIITHVASFYKFDRHGVPDEMRKVESNWNFVEELLKKSISVQGVILEEQLRMYLHCCLTLCDFWEPNIAIVTILWEYYSKNLNSSFSISWLPFKGLANTMKSPLSMLEMVKTCCCDKQDQELYKSSSSYTIFLCILAKVVKKAMKSNGPHPWKQVKGRIYSKFHQKRMEELTEVGLQNFFSLFLLLAAVAEVEDVASHVLDLLNFLKPAFVTSQRALIWKGHMAFLLMYAQKNLDIGVLAEKFSCAFREKAKEFLVSKNEEMVQRQTIWTLLSIYIDGVQEVFETSYCLYPSHEKLLNDGFSMLLRACRESELRTVLSFLQAVLARIRSMHQQLCQELQRDNVDLFVQSSLSAKERHLAAVASALWRHFFSFLKSQRMSQVVPFSQLADAAADFTLLAMDMPSTAPSDFQPQPVISIIQLFGWDDIICPQVVARYLSHVLQNSTLCEALSHSGYVSFQALTVRSWIRCVLQMYIKNLSGPDDLLIDKNLEEAVEKEYMKQLVKLTRLLFNLSEVKSIFSKAQVEYLSISEDPKKALVRFFEAVGVTYGNVQTLSDKSAMVTKSLEYLGEVLKYIKPYLGKKVFSAGLQLTYGMMGILVKSWAQIFATSKAQKLLFRIIDCLLLPHAVLQQEKELPAPMLSAIQKSLPLYLQGMCIVCCQSQNPNAYLNQLLGNVIEQYIGRFLPASPYVSDLGQHPVLLALRNTATIPPISSLKKCIVQVIRKSYLEYKGSSPPPRLASILAFILQLFKETNTDIYEVELLLPGILKCLVLVSEPQVKRLATENLQYMVKACQVGSEEEPSSQLTSVFRQFIQDYGMRYYYQVYSILETVATLDQQVVIHLISTLTQSLKDSEQKWGLGRNIAQREAYSKLLSHLGQMGQDEMQRLENDNT

SEQ ID NO: 52732 - protein, 1203 aa, Homo sapiens
  Payload ID: 10504
  Gene Symbol: MMS22L
  Gene Name: MMS22-like, DNA repair protein
  ENSP ID: ENSP00000358254
MENCSAASTFLTDSLELELGTEWCKPPYFSCAVDNRGGGKHFSGESYLCSGALKRLILNLDPLPTNFEEDTLEIFGIQWVTETALVNSSRELFHLFRQQLYNLETLLQSSCDFGKVSTLHCKADNIRQQCVLFLHYVKVFIFRYLKVQNAESHVPVHPYEALEAQLPSVLIDELHGLLLYIGHLSELPSVNIGAFVNQNQIKLFPPSWHLLHLHLDIHWLVLEILYMLGEKLKQVVYGHQFMNLASDNLTNISLFEEHCETLLCDLISLSLNRYDKVRSSESLMSDQCPCLCIKELWVLLIHLLDHRSKWFVSESFWNWLNKLLKTLLEKSSDRRRSSMPVIQSRDPLGFSWWIITHVASFYKFDRHGVPDEMRKVESNWNFVEELLKKSISVQNSSFSISWLPFKGLANTMKSPLSMLEMVKTCCCDKQDQELYKSSSSYTIFLCILAKVVKKAMKSNGPHPWKQVKGRIYSKFHQKRMEELTEVGLQNFFSLFLLLAAVAEVEDVASHVLDLLNFLKPAFVTSQRALIWKGHMAFLLMYAQKNLDIGVLAEKFSCAFREKAKEFLVSKNEEMVQRQTIWTLLSIYIDGVQEVFETSYCLYPSHEKLLNDGFSMLLRACRESELRTVLSFLQAVLARIRSMHQQLCQELQRDNVDLFVQSSLSAKERHLAAVASALWRHFFSFLKSQRMSQVVPFSQLADAAADFTLLAMDMPSTAPSDFQPQPVISIIQLFGWDDIICPQVVARYLSHVLQNSTLCEALSHSGYVSFQALTVRSWIRCVLQMYIKNLSGPDDLLIDKNLEEAVEKEYMKQLVKLTRLLFNLSEVKSIFSKAQVEYLSISEDPKKALVRFFEAVGVTYGNVQTLSDKSAMVTKSLEYLGEVLKYIKPYLGKKVFSAGLQLTYGMMGILVKSWAQIFATSKAQKLLFRIIDCLLLPHAVLQQEKELPAPMLSAIQKSLPLYLQGMCIVCCQSQNPNAYLNQLLGNVIEQYIGRFLPASPYVSDLGQHPVLLALRNTATIPPISSLKKCIVQVIRKSYLEYKGSSPPPRLASILAFILQLFKETNTDIYEVELLLPGILKCLVLVSEPQVKRLATENLQYMVKACQVGSEEEPSSQLTSVFRQFIQDYGMRYYYQVYSILETVATLDQQVVIHLISTLTQSLKDSEQKWGLGRNIAQREAYSKLLSHLGQMGQDEMQRLENDNT

SEQ ID NO: 52733 - protein, 88 aa, Homo sapiens
  Payload ID: 10504
  Gene Symbol: MMS22L
  Gene Name: MMS22-like, DNA repair protein
  ENSP ID: ENSP00000421225
KWFVSESFWNWLNKLLKTLLEKSSDRRRSSMPVIQSRDPLGFSWWIITHVASFYKFDRHGVPDEMRKVESNWNFVEELLKKSISVQSC

SEQ ID NO: 52734 - protein, 140 aa, Homo sapiens
  Payload ID: 10504
  Gene Symbol: MMS22L
  Gene Name: MMS22-like, DNA repair protein
  ENSP ID: ENSP00000422045
MENCSAASTFLTDSLELELGTEWCKPPYFSCAVDNRGGGKHFSGESYLCSGALKRLILNLDPLPTNFEEDTLEIFGIQWVTETALVNSSRELFHLFRQQLYNLETLLQSSCDFAFSTVMAFITSPLGYTLAGARNSLHAG

SEQ ID NO: 52735 - protein, 203 aa, Homo sapiens
  Payload ID: 10504
  Gene Symbol: MMS22L
  Gene Name: MMS22-like, DNA repair protein
  ENSP ID: ENSP00000422627
MENCSAASTFLTDSLELELGTEWCKPPYFSCAVDNRGGGKHFSGESYLCSGALKRLILNLDPLPTNFEEDTLEIFGIQWVTETALVNSSRELFHLFRQQLYNLETLLQSSCDFGKVSTLHCKADNIRQQCVLFLHYVKVFIFRYLKVQNAESHVPVHPYEALEAQLPSVLIDELHGLLLYIGHLSELPSVNIGAFVNQNQIKL

SEQ ID NO: 52736 - protein, 322 aa, Homo sapiens
  Payload ID: 10504
  Gene Symbol: MMS22L
  Gene Name: MMS22-like, DNA repair protein
  ENSP ID: ENSP00000427288
FGIQWVTETALVNSSRELFHLFRQQLYNLETLLQSSCDFGKVSTLHCKADNIRQQCVLFLHYVKVFIFRYLKVQNAESHVPVHPYEALEAQLPSVLIDELHGLLLYIGHLSELPSVNIGAFVNQNQIKLFPPSWHLLHLHLDIHWLVLEILYMLGEKLKQVVYGHQFMNLASDNLTNISLFEEHCETLLCDLISLSLNRYDKSFWNWLNKLLKTLLEKSSDRRRSSMPVIQSRDPLGFSWWIITHVASFYKFDRHGVPDEMRKVESNWNFVEELLKKSISVQGVILEEQLRMYLHCCLTLCDFWEPNIAIVTILWEYYSKNL

SEQ ID NO: 52737 - protein, 309 aa, Homo sapiens
  Payload ID: 10505
  Gene Symbol: MNAT1
  Gene Name: MNAT CDK-activating kinase assembly factor 1
  Uniprot ID: P51948
  ENSP ID: ENSP00000261245
MDDQGCPRCKTTKYRNPSLKLMVNVCGHTLCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGYLNHVRAASPQDLAGGYTSSLACHRALQDAFSGLFWQPS

SEQ ID NO: 52738 - protein, 267 aa, Homo sapiens
  Payload ID: 10505
  Gene Symbol: MNAT1
  Gene Name: MNAT CDK-activating kinase assembly factor 1
  Uniprot ID: P51948
  ENSP ID: ENSP00000446437
MDDQGCPRCKTTKYRNPSLKLMVNVCGHTLCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELGQHISLAPIHKLEEALYEYQPLQIETYGPHVPELEMLGRLGYLNHVRAASPQDLAGGYTSSLACHRALQDAFSGLFWQPS

SEQ ID NO: 52739 - protein, 169 aa, Homo sapiens
  Payload ID: 10505
  Gene Symbol: MNAT1
  Gene Name: MNAT CDK-activating kinase assembly factor 1
  ENSP ID: ENSP00000451017
TREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGYLNHVRAASPQDLAGGYTSSLACHRALQDAFSGLFWQPS

SEQ ID NO: 52740 - protein, 173 aa, Homo sapiens
  Payload ID: 10505
  Gene Symbol: MNAT1
  Gene Name: MNAT CDK-activating kinase assembly factor 1
  ENSP ID: ENSP00000451379
VFNLTNNVDLDNTKKKMEIYQKENKDVIQKNKLKLTREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGGFDTISLI

SEQ ID NO: 52741 - protein, 193 aa, Homo sapiens
  Payload ID: 10506
  Gene Symbol: MOB4
  Gene Name: MOB family member 4, phocein
  Uniprot ID: Q9Y3A3
  ENSP ID: ENSP00000233892
MDSTLAVQQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 52742 - protein, 225 aa, Homo sapiens
  Payload ID: 10506
  Gene Symbol: MOB4
  Gene Name: MOB family member 4, phocein
  Uniprot ID: Q9Y3A3
  ENSP ID: ENSP00000315702
MVMAEGTAVLRRNRPGTKAQDFYNWPDESFDEMDSTLAVQQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 52743 - protein, 51 aa, Homo sapiens
  Payload ID: 10506
  Gene Symbol: MOB4
  Gene Name: MOB family member 4, phocein
  ENSP ID: ENSP00000387043
MVMAEGTAVLRRNRPGTKAQYIQQNIRADCSNIDKILEPPEGQDEGSSALS

SEQ ID NO: 52744 - protein, 126 aa, Homo sapiens
  Payload ID: 10506
  Gene Symbol: MOB4
  Gene Name: MOB family member 4, phocein
  ENSP ID: ENSP00000387240
MTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 52745 - protein, 193 aa, Homo sapiens; identical to SEQ ID NO: 52741
  Payload ID: 10506
  Gene Symbol: MOB4
  Gene Name: MOB family member 4, phocein
  Uniprot ID: Q9Y3A3
  ENSP ID: ENSP00000387289

SEQ ID NO: 52746 - protein, 45 aa, Homo sapiens
  Payload ID: 10506
  Gene Symbol: MOB4
  Gene Name: MOB family member 4, phocein
  ENSP ID: ENSP00000397052
MVMAEGTAVLRRNRPGTKAQDFYNWPDESFDEMDSTLAVQQAVLP

SEQ ID NO: 52747 - protein, 204 aa, Homo sapiens
  Payload ID: 10506
  Gene Symbol: MOB4
  Gene Name: MOB family member 4, phocein
  Uniprot ID: Q9Y3A3
  ENSP ID: ENSP00000405354
MVMAEGTAVLRRNRPGTKAQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 52748 - protein, 216 aa, Homo sapiens
  Payload ID: 10507
  Gene Symbol: MOB1A
  Gene Name: MOB kinase activator 1A
  Uniprot ID: Q9H8S9
  ENSP ID: ENSP00000379364
MSFLFSSRSSKTFKPKKNIPEGSHQYELLKHAEATLGSGNLRQAVMLPEGEDLNEWIAVNTVDFFNQINMLYGTITEFCTEASCPVMSAGPRYEYHWADGTNIKKPIKCSAPKYIDYLMTWVQDQLDDETLFPSKIGVPFPKNFMSVAKTILKRLFRVYAHIYHQHFDSVMQLQEEAHLNTSFKHFIFFVQEFNLIDRRELAPLQELIEKLGSKDR

SEQ ID NO: 52749 - protein, 216 aa, Homo sapiens
  Payload ID: 10508
  Gene Symbol: MOB1B
  Gene Name: MOB kinase activator 1B
  Uniprot ID: Q7L9L4
  ENSP ID: ENSP00000310189
MSFLFGSRSSKTFKPKKNIPEGSHQYELLKHAEATLGSGNLRMAVMLPEGEDLNEWVAVNTVDFFNQINMLYGTITDFCTEESCPVMSAGPKYEYHWADGTNIKKPIKCSAPKYIDYLMTWVQDQLDDETLFPSKIGVPFPKNFMSVAKTILKRLFRVYAHIYHQHFDPVIQLQEEAHLNTSFKHFIFFVQEFNLIDRRELAPLQELIEKLTSKDR

SEQ ID NO: 52750 - protein, 221 aa, Homo sapiens
  Payload ID: 10508
  Gene Symbol: MOB1B
  Gene Name: MOB kinase activator 1B
  Uniprot ID: Q7L9L4
  ENSP ID: ENSP00000379366
MEGATDVNESGSRSSKTFKPKKNIPEGSHQYELLKHAEATLGSGNLRMAVMLPEGEDLNEWVAVNTVDFFNQINMLYGTITDFCTEESCPVMSAGPKYEYHWADGTNIKKPIKCSAPKYIDYLMTWVQDQLDDETLFPSKIGVPFPKNFMSVAKTILKRLFRVYAHIYHQHFDPVIQLQEEAHLNTSFKHFIFFVQEFNLIDRRELAPLQELIEKLTSKDR

SEQ ID NO: 52751 - protein, 130 aa, Homo sapiens
  Payload ID: 10508
  Gene Symbol: MOB1B
  Gene Name: MOB kinase activator 1B
  ENSP ID: ENSP00000427216
MEGATDVNESGSRSSKTFKPKKNIPEGSHQYELLKHAEATLGSGNLRMAVMLPEGEDLNEWVAVNTVDFFNQINMLYGTITDFCTEESCPVMSAGPKYEYHWADGTNIKKPIKCSAPKYIDYLMTWVQDQ

SEQ ID NO: 52752 - protein, 268 aa, Homo sapiens
  Payload ID: 10509
  Gene Symbol: MOB2
  Gene Name: MOB kinase activator 2
  Uniprot ID: Q70IA6
  ENSP ID: ENSP00000328694
MLGDHCSLPEDQARPGQSLQSGLCCKMVLQAVSKVLRKSKAKPNGKKPAAEERKAYLEPEHTKARITDFQFKELVVLPREIDLNEWLASNTTTFFHHINLQYSTISEFCTGETCQTMAVCNTQYYWYDERGKKVKCTAPQYVDFVMSSVQKLVTDEDVFPTKYGREFPSSFESLVRKICRHLFHVLAHIYWAHFKETLALELHGHLNTLYVHFILFAREFNLLDPKETAIMDDLTEVLCSGAGGVHSGGSGDGAGSGGPGAQNHVKER

SEQ ID NO: 52753 - protein, 236 aa, Homo sapiens
  Payload ID: 10509
  Gene Symbol: MOB2
  Gene Name: MOB kinase activator 2
  ENSP ID: ENSP00000479647
GWRTWKSKAKPNGKKPAAEERKAYLEPEHTKARITDFQFKELVVLPREIDLNEWLASNTTTFFHHINLQYSTISEFCTGETCQTMAVCNTQYYWYDERGKKVKCTAPQYVDFVMSSVQKLVTDEDVFPTKYGREFPSSFESLVRKICRHLFHVLAHIYWAHFKETLALELHGHLNTLYVHFILFAREFNLLDPKETAIMDDLTEVLCSGAGGVHSGGSGDGAGSGGPGAQNHVKER

SEQ ID NO: 52754 - protein, 217 aa, Homo sapiens
  Payload ID: 10510
  Gene Symbol: MOB3A
  Gene Name: MOB kinase activator 3A
  Uniprot ID: Q96BX8
  ENSP ID: ENSP00000349575
MSNPFLKQVFNKDKTFRPKRKFEPGTQRFELHKKAQASLNAGLDLRLAVQLPPGEDLNDWVAVHVVDFFNRVNLIYGTISDGCTEQSCPVMSGGPKYEYRWQDEHKFRKPTALSAPRYMDLLMDWIEAQINNEDLFPTNVGTPFPKNFLQTVRKILSRLFRVFVHVYIHHFDRIAQMGSEAHVNTCYKHFYYFVKEFGLIDTKELEPLKEMTARMCH

SEQ ID NO: 52755 - protein, 62 aa, Homo sapiens
  Payload ID: 10510
  Gene Symbol: MOB3A
  Gene Name: MOB kinase activator 3A
  ENSP ID: ENSP00000465662
MSNPFLKQVFNKDKTFRPKRKFEPGTQRFELHKKAQASLNAGLDLRLAVQLPPGEDLNDWVA

SEQ ID NO: 52756 - protein, 16 aa, Homo sapiens
  Payload ID: 10510
  Gene Symbol: MOB3A
  Gene Name: MOB kinase activator 3A
  ENSP ID: ENSP00000466080
MSNPFLKQVFNKDKTF

SEQ ID NO: 52757 - protein, 63 aa, Homo sapiens
  Payload ID: 10510
  Gene Symbol: MOB3A
  Gene Name: MOB kinase activator 3A
  ENSP ID: ENSP00000466199
MSNPFLKQVFNKDKTFRPKRKFEPGTQRFELHKKAQASLNAGLDLRLAVQLPPGEDLNDWVAV

SEQ ID NO: 52758 - protein, 217 aa, Homo sapiens; identical to SEQ ID NO: 52754
  Payload ID: 10510
  Gene Symbol: MOB3A
  Gene Name: MOB kinase activator 3A
  Uniprot ID: Q96BX8
  ENSP ID: ENSP00000466249

SEQ ID NO: 52759 - protein, 54 aa, Homo sapiens [sequence omitted]

SEQ ID NO: 52760 - protein, 76 aa, Homo sapiens
  Payload ID: 10510
  Gene Symbol: MOB3A
  Gene Name: MOB kinase activator 3A
  ENSP ID: ENSP00000468628
MSNPFLKQVFNKDKTFRPKRKFEPGTQRFELHKKAQASLNAGLDLRLAVQLPPGEDLNDWVAVHVVDFFNRVNLIY

SEQ ID NO: 52761 - protein, 38 aa, Homo sapiens
  Payload ID: 10510
  Gene Symbol: MOB3A
  Gene Name: MOB kinase activator 3A
  ENSP ID: ENSP00000468726
MSNPFLKQVFNKDKTFRPKRKFEPGTQRFELHKKAQAS

SEQ ID NO: 52762 - protein, 216 aa, Homo sapiens
  Payload ID: 10511
  Gene Symbol: MOB3B
  Gene Name: MOB kinase activator 3B
  Uniprot ID: Q86TA1
  ENSP ID: ENSP00000262244
MSIALKQVFNKDKTFRPKRKFEPGTQRFELHKRAQASLNSGVDLKAAVQLPSGEDQNDWVAVHVVDFFNRINLIYGTICEFCTERTCPVMSGGPKYEYRWQDDLKYKKPTALPAPQYMNLLMDWIEVQINNEEIFPTCVGVPFPKNFLQICKKILCRLFRVFVHVYIHHFDRVIVMGAEAHVNTCYKHFYYFVTEMNLIDRKELEPLKEMTSRMCH

SEQ ID NO: 52763 - protein, 268 aa, Homo sapiens
  Payload ID: 10512
  Gene Symbol: MOB3C
  Gene Name: MOB kinase activator 3C
  ENSP ID: ENSP00000271139
MKRRNLFALETGVPPWGLLWVRSRRVGMDEMTFHIWYPQVRAPGQQPQAQLAMALCLKQVFAKDKTFRPRKRFEPGTQRFELYKKAQASLKSGLDLRSVVRLPPGENIDDWIAVHVVDFFNRINLIYGTMAERCSETSCPVMAGGPRYEYRWQDERQYRRPAKLSAPRYMALLMDWIEGLINDEEVFPTRVGVPFPKNFQQVCTKILTRLFRVFVHVYIHHFDSILSMGAEAHVNTCYKHFYYFIREFSLVDQRELEPLREMTERICH

SEQ ID NO: 52764 - protein, 216 aa, Homo sapiens
  Payload ID: 10512
  Gene Symbol: MOB3C
  Gene Name: MOB kinase activator 3C
  Uniprot ID: Q70IA8
  ENSP ID: ENSP00000315113
MALCLKQVFAKDKTFRPRKRFEPGTQRFELYKKAQASLKSGLDLRSVVRLPPGENIDDWIAVHVVDFFNRINLIYGTMAERCSETSCPVMAGGPRYEYRWQDERQYRRPAKLSAPRYMALLMDWIEGLINDEEVFPTRVGVPFPKNFQQVCTKILTRLFRVFVHVYIHHFDSILSMGAEAHVNTCYKHFYYFIREFSLVDQRELEPLREMTERICH

SEQ ID NO: 52765 - protein, 216 aa, Homo sapiens; identical to SEQ ID NO: 52764
  Payload ID: 10512
  Gene Symbol: MOB3C
  Gene Name: MOB kinase activator 3C
  Uniprot ID: Q70IA8
  ENSP ID: ENSP00000361008

SEQ ID NO: 52766 - protein, 351 aa, Homo sapiens
  Payload ID: 10513
  Gene Symbol: MOAP1
  Gene Name: modulator of apoptosis 1
  Uniprot ID: Q96BY2
  ENSP ID: ENSP00000298894
MTLRLLEDWCRGMDMNPRKALLIAGISQSCSVAEIEEALQAGLAPLGEYRLLGRMFRRDENRKVALVGLTAETSHALVPKEIPGKGGIWRVIFKPPDPDNTFLSRLNEFLAGEGMTVGELSRALGHENGSLDPEQGMIPEMWAPMLAQALEALQPALQCLKYKKLRVFSGRESPEPGEEEFGRWMFHTTQMIKAWQVPDVEKRRRLLESLRGPALDVIRVLKINNPLITVDECLQALEEVFGVTDNPRELQVKYLTTYQKDEEKLSAYVLRLEPLLQKLVQRGAIERDAVNQARLDQVIAGAVHKTIRRELNLPEDGPAPGFLQLLVLIKDYEAAEEEEALLQAILEGNFT

SEQ ID NO: 52767 - protein, 351 aa, Homo sapiens; identical to SEQ ID NO: 52766
  Payload ID: 10513
  Gene Symbol: MOAP1
  Gene Name: modulator of apoptosis 1
  Uniprot ID: Q96BY2
  ENSP ID: ENSP00000451594

SEQ ID NO: 52768 - protein, 351 aa, Homo sapiens; identical to SEQ ID NO: 52766
  Payload ID: 10513
  Gene Symbol: MOAP1
  Gene Name: modulator of apoptosis 1
  Uniprot ID: Q96BY2
  ENSP ID: ENSP00000482284

SEQ ID NO: 52769 - protein, 351 aa, Homo sapiens; identical to SEQ ID NO: 52766
  Payload ID: 10513
  Gene Symbol: MOAP1
  Gene Name: modulator of apoptosis 1
  Uniprot ID: Q96BY2
  ENSP ID: ENSP00000486260

SEQ ID NO: 52770 - protein, 577 aa, Homo sapiens
  Payload ID: 10514
  Gene Symbol: MSN
  Gene Name: moesin
  Uniprot ID: P26038
  ENSP ID: ENSP00000353408
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 52771 - protein, 103 aa, Homo sapiens
  Payload ID: 10514
  Gene Symbol: MSN
  Gene Name: moesin
  ENSP ID: ENSP00000477441
MDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDD

SEQ ID NO: 52772 - protein, 352 aa, Homo sapiens
  Payload ID: 10515
  Gene Symbol: MKX
  Gene Name: mohawk homeobox
  Uniprot ID: Q8IYA7
  ENSP ID: ENSP00000364946
MNTIVFNKLSGAVLFEDGGASERERGGRPYSGVLDSPHARPEVGIPDGPPLKDNLGLRHRRTGARQNGGKVRHKRQALQDMARPLKQWLYKHRDNPYPTKTEKILLALGSQMTLVQVSNWFANARRRLKNTVRQPDLSWALRIKLYNKYVQGNAERLSVSSDDSCSEDGENPPRTHMNEGGYNTPVHHPVIKSENSVIKAGVRPESRASEDYVAPPKYKSSLLNRYLNDSLRHVMATNTTMMGKTRQRNHSGSFSSNEFEEELVSPSSSETEGNFVYRTDTLENGSNKGESAANRKGPSKDDTYWKEINAAMALTNLAQGKDKLQGTTSCIIQKSSHIAEVKTVKVPLVQQF

SEQ ID NO: 52773 - protein, 352 aa, Homo sapiens; identical to SEQ ID NO: 52772
  Payload ID: 10515
  Gene Symbol: MKX
  Gene Name: mohawk homeobox
  Uniprot ID: Q8IYA7
  ENSP ID: ENSP00000400896

SEQ ID NO: 52774 - protein, 290 aa, Homo sapiens
  Payload ID: 10515
  Gene Symbol: MKX
  Gene Name: mohawk homeobox
  ENSP ID: ENSP00000452751
MNTIVFNKLSGAVLFEDGGASERERGGRPYSGVLDSPHARPEVGIPDGPPLKDNLGLRHRRTGARQNGGKVRHKRQALQDMARPLKQWLYKHRDNPYPTKTEKILLALGSQMTLVQVSNWFANARRRLKNTVRQPDLSWALRIKLYNKYVQGNAERLSVSSDDSCSEDGENPPRTHMNEGGYNTPVHHPVIKSENSVIKAGVRPESRASEDYVAPPKYKSSLLNRYLNDSLRHVMATNTTMMGKTRQRNHSGSFSSNEFEEELVSPSSSETEGNFVYRTVENLGSLSEDS

SEQ ID NO: 52775 - protein, 58 aa, Homo sapiens
  Payload ID: 10515
  Gene Symbol: MKX
  Gene Name: mohawk homeobox
  ENSP ID: ENSP00000453746
MNTIVFNKLSGAVLFEDGGASERERGGRPYSGVLDSPHARPEVGIPDGPPLKDNLGLR

SEQ ID NO: 52776 - protein, 418 aa, Homo sapiens
  Payload ID: 10516
  Gene Symbol: MOK
  Gene Name: MOK protein kinase
  ENSP ID: ENSP00000193029
IKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 52777 - protein, 419 aa, Homo sapiens
  Payload ID: 10516
  Gene Symbol: MOK
  Gene Name: MOK protein kinase
  Uniprot ID: Q9UQ07
  ENSP ID: ENSP00000355304
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 52778 - protein, 44 aa, Homo sapiens
  Payload ID: 10516
  Gene Symbol: MOK
  Gene Name: MOK protein kinase
  ENSP ID: ENSP00000427884
MKNYKAIGKIGEGTFSEVMKMQSLRDGNYYACKQMKQRFERLGN

SEQ ID NO: 52779 - protein, 59 aa, Homo sapiens
  Payload ID: 10516
  Gene Symbol: MOK
  Gene Name: MOK protein kinase
  ENSP ID: ENSP00000428206
MKNYKAIGKIGEGTFSEVMKMQSLRDGNYYACKQMKQRFEREKIPIIRKKNYALYVPVM

SEQ ID NO: 52780 - protein, 389 aa, Homo sapiens
  Payload ID: 10516
  Gene Symbol: MOK
  Gene Name: MOK protein kinase
  Uniprot ID: Q9UQ07
  ENSP ID: ENSP00000428942
MKNYKAIGKIGEGTFSEVMKMQSLRDGNYYACKQMKQRFESDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 52781 - protein, 44 aa, Homo sapiens; identical to SEQ ID NO: 52778
  Payload ID: 10516
  Gene Symbol: MOK
  Gene Name: MOK protein kinase
  ENSP ID: ENSP00000428957

SEQ ID NO: 52782 - protein, 59 aa, Homo sapiens; identical to SEQ ID NO: 52779
  Payload ID: 10516
  Gene Symbol: MOK
  Gene Name: MOK protein kinase
  ENSP ID: ENSP00000429348

SEQ ID NO: 52783 - protein, 44 aa, Homo sapiens; identical to SEQ ID NO: 52778
  Payload ID: 10516
  Gene Symbol: MOK
  Gene Name: MOK protein kinase
  ENSP ID: ENSP00000429428

SEQ ID NO: 52784 - protein, 418 aa, Homo sapiens
  Payload ID: 10516
  Gene Symbol: MOK
  Gene Name: MOK protein kinase
  Uniprot ID: Q9UQ07
  ENSP ID: ENSP00000429469
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 52785 - protein, 151 aa, Homo sapiens
  Payload ID: 10516
  Gene Symbol: MOK
  Gene Name: MOK protein kinase
  ENSP ID: ENSP00000429511
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKVVKNGLFNKCHQHN

SEQ ID NO: 52786 - protein, 59 aa, Homo sapiens; identical to SEQ ID NO: 52779
  Payload ID: 10516
  Gene Symbol: MOK
  Gene Name: MOK protein kinase
  ENSP ID: ENSP00000429570

SEQ ID NO: 52787 - protein, 125 aa, Homo sapiens
  Payload ID: 10516
  Gene Symbol: MOK
  Gene Name: MOK protein kinase
  ENSP ID: ENSP00000429672
MIPMRESPPTRPCSTPTSKNRETVPKARGGPSQETRTGLCHGTAQTKAFGSGQTVVLLQPHAAVRAWIWNKWKSAGAETLEVHPCEQEGSAEPASLTALLFDPAQAATEFCVCNFSLTDRSAEGP

SEQ ID NO: 52788 - protein, 113 aa, Homo sapiens
  Payload ID: 10516
  Gene Symbol: MOK
  Gene Name: MOK protein kinase
  ENSP ID: ENSP00000430416
  MOD_RES (1)..(1): Any amino acid
XKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKVARNQLL

SEQ ID NO: 52789 - protein, 59 aa, Homo sapiens; identical to SEQ ID NO: 52779
  Payload ID: 10516
  Gene Symbol: MOK
  Gene Name: MOK protein kinase
  ENSP ID: ENSP00000430775

SEQ ID NO: 52790 - protein, 95 aa, Homo sapiens
  Payload ID: 10516
  Gene Symbol: MOK
  Gene Name: MOK protein kinase
  ENSP ID: ENSP00000452978
MIPMRESPPTRPCSTPTSKNRETVPKARGGPSQETRTGLCHGTAQTKAFGSGQTVVLLQPHAAVRAWIWNKWKSAGAETLEVHPCEQEDRSAEGP

SEQ ID NO: 52791 - protein, 95 aa, Homo sapiens; identical to SEQ ID NO: 52790
  Payload ID: 10516
  Gene Symbol: MOK
  Gene Name: MOK protein kinase
  ENSP ID: ENSP00000453224

SEQ ID NO: 52792 - protein, 47 aa, Homo sapiens
  Payload ID: 10516
  Gene Symbol: MOK
  Gene Name: MOK protein kinase
  ENSP ID: ENSP00000453401
MIPMRESPPTRPCSTPTSKNREPRTEARMRPQPSSSPFKHVHPSTLC

SEQ ID NO: 52793 - protein, 173 aa, Homo sapiens
  Payload ID: 10516
  Gene Symbol: MOK
  Gene Name: MOK protein kinase
  ENSP ID: ENSP00000453449
  MOD_RES (1)..(1): Any amino acid
XNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRRLTP

SEQ ID NO: 52794 - protein, 95 aa, Homo sapiens; identical to SEQ ID NO: 52790
  Payload ID: 10516
  Gene Symbol: MOK
  Gene Name: MOK protein kinase
  ENSP ID: ENSP00000453762

SEQ ID NO: 52795 - protein, 96 aa, Homo sapiens
  Payload ID: 10516
  Gene Symbol: MOK
  Gene Name: MOK protein kinase
  ENSP ID: ENSP00000453799
MIPMRESPPTRPCSTPTSKNRETVPKARGGPSQETRTGLCHGTAQTKAFGSGQTVVLLQPHAAVRAWIWNKWKSAGAETLEVHPCEQEGSAEPASL

SEQ ID NO: 52796 - protein, 47 aa, Homo sapiens; identical to SEQ ID NO: 52792
  Payload ID: 10516
  Gene Symbol: MOK
  Gene Name: MOK protein kinase
  ENSP ID: ENSP00000453950

SEQ ID NO: 52797 - protein, 95 aa, Homo sapiens; identical to SEQ ID NO: 52790
  Payload ID: 10516
  Gene Symbol: MOK
  Gene Name: MOK protein kinase
  ENSP ID: ENSP00000454098

SEQ ID NO: 52798 - protein, 125 aa, Homo sapiens; identical to SEQ ID NO: 52787
  Payload ID: 10516
  Gene Symbol: MOK
  Gene Name: MOK protein kinase
  ENSP ID: ENSP00000454203

SEQ ID NO: 52799 - protein, 89 aa, Homo sapiens
  Payload ID: 10516
  Gene Symbol: MOK
  Gene Name: MOK protein kinase
  ENSP ID: ENSP00000454829
MKNYKAIGKIGEGTFSEVMKMQSLRDGNYYACKQMKQRFESIEQVNNLREIQALRRLNPHPNILMLHEVVLEKIPIIRKKNYALYVPVM

SEQ ID NO: 52800 - protein, 888 aa, Homo sapiens
  Payload ID: 10517
  Gene Symbol: MOCOS
  Gene Name: molybdenum cofactor sulfurase
  Uniprot ID: Q96EN8
  ENSP ID: ENSP00000261326
MAGAAAESGRELWTFAGSRDPSAPRLAYGYGPGSLRELRAREFSRLAGTVYLDHAGATLFSQSQLESFTSDLMENTYGNPHSQNISSKLTHDTVEQVRYRILAHFHTTAEDYTVIFTAGSTAALKLVAEAFPWVSQGPESSGSRFCYLTDSHTSVVGMRNVTMAINVISTPVRPEDLWSAEERSASASNPDCQLPHLFCYPAQSNFSGVRYPLSWIEEVKSGRLHPVSTPGKWFVLLDAASYVSTSPLDLSAHQADFVPISFYKIFGFPTGLGALLVHNRAAPLLRKTYFGGGTASAYLAGEDFYIPRQSVAQRFEDGTISFLDVIALKHGFDTLERLTGGMENIKQHTFTLAQYTYVALSSLQYPNGAPVVRIYSDSEFSSPEVQGPIINFNVLDDKGNIIGYSQVDKMASLYNIHLRTGCFCNTGACQRHLGISNEMVRKHFQAGHVCGDNMDLIDGQPTGSVRISFGYMSTLDDVQAFLRFIIDTRLHSSGDWPVPQAHADTGETGAPSADSQADVIPAVMGRRSLSPQEDALTGSRVWNNSSTVNAVPVAPPVCDVARTQPTPSEKAAGVLEGALGPHVVTNLYLYPIKSCAAFEVTRWPVGNQGLLYDRSWMVVNHNGVCLSQKQEPRLCLIQPFIDLRQRIMVIKAKGMEPIEVPLEENSERTQIRQSRVCADRVSTYDCGEKISSWLSTFFGRPCHLIKQSSNSQRNAKKKHGKDQLPGTMATLSLVNEAQYLLINTSSILELHRQLNTSDENGKEELFSLKDLSLRFRANIIINGKRAFEEEKWDEISIGSLRFQVLGPCHRCQMICIDQQTGQRNQHVFQKLSESRETKVNFGMYLMHASLDLSSPCFLSVGSQVLPVLKENVEGHDLPASEKHQDVTS

SEQ ID NO: 52801 - protein, 636 aa, Homo sapiens
  Payload ID: 10518
  Gene Symbol: MOCS1
  Gene Name: molybdenum cofactor synthesis 1
  Uniprot ID: Q9NZB8
  ENSP ID: ENSP00000344794
MAARPLSRMLRRLLRSSARSCSSGAPVTQPCPGESARAASEEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIELFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 52802 - protein, 281 aa, Homo sapiens
  Payload ID: 10518
  Gene Symbol: MOCS1
  Gene Name: molybdenum cofactor synthesis 1
  Uniprot ID: Q9NZB8
  ENSP ID: ENSP00000362277
MPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAE

SEQ ID NO: 52803 - protein, 385 aa, Homo sapiens
  Payload ID: 10518
  Gene Symbol: MOCS1
  Gene Name: molybdenum cofactor synthesis 1
  Uniprot ID: Q9NZB8
  ENSP ID: ENSP00000362282
MWKSWKLRTDVRVREGAGGSPCASSQPGSRGPCFLPGLSSQEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIGG

SEQ ID NO: 52804 - protein, 385 aa, Homo sapiens
  Payload ID: 10518
  Gene Symbol: MOCS1
  Gene Name: molybdenum cofactor synthesis 1
  Uniprot ID: Q9NZB8
  ENSP ID: ENSP00000362284
MAARPLSRMLRRLLRSSARSCSSGAPVTQPCPGESARAASEEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIGG

SEQ ID NO: 52805 - protein, 533 aa, Homo sapiens
  Payload ID: 10518
  Gene Symbol: MOCS1
  Gene Name: molybdenum cofactor synthesis 1
  Uniprot ID: Q9NZB8
  ENSP ID: ENSP00000362291
MPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAELFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 52806 - protein, 356 aa, Homo sapiens
  Payload ID: 10518
  Gene Symbol: MOCS1
  Gene Name: molybdenum cofactor synthesis 1
  Uniprot ID: Q9NZB8
  ENSP ID: ENSP00000410809
MWKSWKLRTDVREVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIGG

SEQ ID NO: 52807 - protein, 636 aa, Homo sapiens
  Payload ID: 10518
  Gene Symbol: MOCS1
  Gene Name: molybdenum cofactor synthesis 1
  Uniprot ID: Q9NZB8
  ENSP ID: ENSP00000416478
MWKSWKLRTDVRVREGAGGSPCASSQPGSRGPCFLPGLSSQEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIELFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 52808 - protein, 98 aa, Homo sapiens
  Payload ID: 10518
  Gene Symbol: MOCS1
  Gene Name: molybdenum cofactor synthesis 1
  ENSP ID: ENSP00000418315
MAARPLSRMLRRLLRSSARSCSSGAPVTQPCPGESARAASEEVSRRRQFLREHAAPFSAFLTDSFGRQHSYLRISLTEKCNLRCESPSWALSGLVSIC

SEQ ID NO: 52809 - protein, 88 aa, Homo sapiens
  Payload ID: 10519
  Gene Symbol: MOCS2
  Gene Name: molybdenum cofactor synthesis 2
  Uniprot ID: O96033
  ENSP ID: ENSP00000355160
MVPLCQVEVLYFAKSAEITGVRSETISVPQEIKALQLWKEIETRHPGLADVRNQIIFAVRQEYVELGDQLLVLQPGDEIAVIPPISGG

SEQ ID NO: 52810 - protein, 188 aa, Homo sapiens
  Payload ID: 10519
  Gene Symbol: MOCS2
  Gene Name: molybdenum cofactor synthesis 2
  Uniprot ID: O96007
  ENSP ID: ENSP00000380157
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKEIYEESSTWKGNKECFWASNS

SEQ ID NO: 52811 - protein, 88 aa, Homo sapiens; identical to SEQ ID NO: 52809
  Payload ID: 10519
  Gene Symbol: MOCS2
  Gene Name: molybdenum cofactor synthesis 2
  Uniprot ID: O96033
  ENSP ID: ENSP00000411022

SEQ ID NO: 52812 - protein, 88 aa, Homo sapiens; identical to SEQ ID NO: 52809
  Payload ID: 10519
  Gene Symbol: MOCS2
  Gene Name: molybdenum cofactor synthesis 2
  Uniprot ID: O96033
  ENSP ID: ENSP00000424267

SEQ ID NO: 52813 - protein, 88 aa, Homo sapiens; identical to SEQ ID NO: 52809
  Payload ID: 10519
  Gene Symbol: MOCS2
  Gene Name: molybdenum cofactor synthesis 2
  Uniprot ID: O96033
  ENSP ID: ENSP00000426274

SEQ ID NO: 52814 - protein, 83 aa, Homo sapiens
  Payload ID: 10519
  Gene Symbol: MOCS2
  Gene Name: molybdenum cofactor synthesis 2
  ENSP ID: ENSP00000435326
MVEVLYFAKSAEITGVRSETISVPQEIKALQLWKEIETRHPGLADVRNQIIFAVRQEYVELGDQLLVLQPGDEIAVIPPISGG

SEQ ID NO: 52815 - protein, 88 aa, Homo sapiens; identical to SEQ ID NO: 52809
  Payload ID: 10519
  Gene Symbol: MOCS2
  Gene Name: molybdenum cofactor synthesis 2
  Uniprot ID: O96033
  ENSP ID: ENSP00000462870

SEQ ID NO: 52816 - protein, 88 aa, Homo sapiens; identical to SEQ ID NO: 52809
  Payload ID: 10519
  Gene Symbol: MOCS2
  Gene Name: molybdenum cofactor synthesis 2
  Uniprot ID: O96033
  ENSP ID: ENSP00000464663

SEQ ID NO: 52817 - protein, 460 aa, Homo sapiens
  Payload ID: 10520
  Gene Symbol: MOCS3
  Gene Name: molybdenum cofactor synthesis 3
  Uniprot ID: O95396
  ENSP ID: ENSP00000244051
MASREEVLALQAEVAQREEELNSLKQKLASALLAEQEPQPERLVPVSPLPPKAALSRDEILRYSRQLVLPELGVHGQLRLGTACVLIVGCGGLGCPLAQYLAAAGVGRLGLVDYDVVEMSNLARQVLHGEALAGQAKAFSAAASLRRLNSAVECVPYTQALTPATALDLVRRYDVVADCSDNVPTRYLVNDACVLAGRPLVSASALRFEGQITVYHYDGGPCYRCIFPQPPPAETVTNCADGGVLGVVTGVLGCLQALEVLKIAAGLGPSYSGSLLLFDALRGHFRSIRLRSRRLDCAACGERPTVTDLLDYEAFCGSSATDKCRSLQLLSPEERVSVTDYKRLLDSGAFHLLLDVRPQVEVDICRLPHALHIPLKHLERRDAESLKLLKEAIWEEKQGTQEGAAVPIYVICKLGNDSQKAVKILQSLSAAQELDPLTVRDVVGGLMAWAAKIDGTFPQY

SEQ ID NO: 52818 - protein, 652 aa, Homo sapiens
  Payload ID: 10521
  Gene Symbol: MON1A
  Gene Name: MON1 secretory trafficking family member A
  ENSP ID: ENSP00000296473
MHPGGGPSRAERLELGLGRERPAKAIFLHRRPGEGGGRERCLRCGHVCVRRGPGPREAVPSGRPRPDTLTPPWVRQRAVTGTFCASWTPLRNRRAQRMATDMQRKRSSECLDGTLTPSDGQSMERAESPTPGMAQGMEPGAGQEGAMFVHARSYEDLTESEDGAASGDSHKEGTRGPPPLPTDMRQISQDFSELSTQLTGVARDLQEEMLPGSSEDWLEPPGAVGRPATEPPREGTTEGDEEDATEAWRLHQKHVFVLSEAGKPVYSRYGSEEALSSTMGVMVALVSFLEADKNAIRSIHADGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWVTGAFELYMCYSPLGTKASAVSAIHKLMRWIRKEEDRLFILTPLTY

SEQ ID NO: 52819 - protein, 563 aa, Homo sapiens
  Payload ID: 10521
  Gene Symbol: MON1A
  Gene Name: MON1 secretory trafficking family member A
  ENSP ID: ENSP00000399613
MTPRRAQRMATDMQRKRSSECLDGTLTPSDGQSMERAESPTPGMAQGMEPGAGQEGAMFVHARSYEDLTESEDGAASGDSHKEGTRGPPPLPTDMRQISQDFSELSTQLTGVARDLQEEMLPGSSEDWLEPPGAVGRPATEPPREGTTEGDEEDATEAWRLHQKHVFVLSEAGKPVYSRYGSEEALSSTMGVMVALVSFLEADKNAIRSIHADGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWVTGAFELYMCYSPLGTKASAVSAIHKLMRWIRKEEDRLFILTPLTY

SEQ ID NO: 52820 - protein, 490 aa, Homo sapiens
  Payload ID: 10521
  Gene Symbol: MON1A
  Gene Name: MON1 secretory trafficking family member A
  Uniprot ID: Q86VX9
  ENSP ID: ENSP00000404793
MHPGGGPSRAERLELGLGRERPAKAIFLHRRPGEGGGRERCLRCGHVCVRRGPGPREAVPSGRPRPDTLTPPWVRQRAVTGTFCASWTPLRNRRAQRMATDMQRKRSSECLDGTLTPSDGQSMERAESPTPGMAQGMEPDGYKVVFVRRSPLVLVAVARTRQSAQELAQELLYIYYQILSLLTGAQLSHIFQQKQNYDLRRLLSGSERITDNLLQLMARDPSFLMGAARCLPLAAAVRDTVSASLQQARARSLVFSILLARNQLVALVRRKDQFLHPIDLHLLFNLISSSSSFREGEAWTPVCLPKFNAAGFFHAHISYLEPDTDLCLLLVSTDREDFFAVSDCRRRFQERLRKRGAHLALREALRTPYYSVAQVGIPDLRHFLYKSKSSGLFTSPEIEAPYTSEEEQERLLGLYQYLHSRAHNASRPLKTIYYTGPNENLLAWVTGAFELYMCYSPLGTKASAVSAIHKLMRWIRKEEDRLFILTPLTY

SEQ ID NO: 52821 - protein, 547 aa, Homo sapiens
  Payload ID: 10522
  Gene Symbol: MON1B
  Gene Name: MON1 secretory trafficking family member B
  Uniprot ID: Q7L1V2
  ENSP ID: ENSP00000248248
MEVGGDTAAPAPGGAEDLEDTQFPSEEAREGGGVHAVPPDPEDEGLEETGSKDKDQPPSPSPPPQSEALSSTSRLWSPAAPENSPTCSPESSSGGQGGDPSDEEWRSQRKHVFVLSEAGKPIYSRYGSVEALSATMGVMTALVSFVQSAGDAIRAIYAEDHKLVFLQQGPLLLVAMSRTSQSAAQLRGELLAVHAQIVSTLTRASVARIFAHKQNYDLRRLLAGSERTLDRLLDSMEQDPGALLLGAVRCVPLARPLRDALGALLRRCTAPGLALSVLAVGGRLITAAQERNVLAECRLDPADLQLLLDWVGAPAFAAGEAWAPVCLPRFNPDGFFYAYVARLDAMPVCLLLLGTQREAFHAMAACRRLVEDGMHALGAMRALGEAASFSNASSASAPAYSVQAVGAPGLRHFLYKPLDIPDHHRQLPQFTSPELEAPYSREEERQRLSDLYHRLHARLHSTSRPLRLIYHVAEKETLLAWVTSKFELYTCLSPLVTKAGAILVVTKLLRWVKKEEDRLFIRYPPKYSTPPATSTDQAAHNGLFTGL

SEQ ID NO: 52822 - protein, 438 aa, Homo sapiens
  Payload ID: 10522
  Gene Symbol: MON1B
  Gene Name: MON1 secretory trafficking family member B
  ENSP ID: ENSP00000404053
MEVGGDTAAPAPGGAEDLEDTQFPSEEAREGGGVHAVPPDPEDEGLEETEDHKLVFLQQGPLLLVAMSRTSQSAAQLRGELLAVHAQIVSTLTRASVARIFAHKQNYDLRRLLAGSERTLDRLLDSMEQDPGALLLGAVRCVPLARPLRDALGALLRRCTAPGLALSVLAVGGRLITAAQERNVLAECRLDPADLQLLLDWVGAPAFAAGEAWAPVCLPRFNPDGFFYAYVARLDAMPVCLLLLGTQREAFHAMAACRRLVEDGMHALGAMRALGEAASFSNASSASAPAYSVQAVGAPGLRHFLYKPLDIPDHHRQLPQFTSPELEAPYSREEERQRLSDLYHRLHARLHSTSRPLRLIYHVAEKETLLAWVTSKFELYTCLSPLVTKAGAILVVTKLLRWVKKEEDRLFIRYPPKYSTPPATSTDQAAHNGLFTGL

SEQ ID NO: 52823 - protein, 401 aa, Homo sapiens
  Payload ID: 10522
  Gene Symbol: MON1B
  Gene Name: MON1 secretory trafficking family member B
  Uniprot ID: Q7L1V2
  ENSP ID: ENSP00000444881
MVSGQLRFGVKTEDHKLVFLQQGPLLLVAMSRTSQSAAQLRGELLAVHAQIVSTLTRASVARIFAHKQNYDLRRLLAGSERTLDRLLDSMEQDPGALLLGAVRCVPLARPLRDALGALLRRCTAPGLALSVLAVGGRLITAAQERNVLAECRLDPADLQLLLDWVGAPAFAAGEAWAPVCLPRFNPDGFFYAYVARLDAMPVCLLLLGTQREAFHAMAACRRLVEDGMHALGAMRALGEAASFSNASSASAPAYSVQAVGAPGLRHFLYKPLDIPDHHRQLPQFTSPELEAPYSREEERQRLSDLYHRLHARLHSTSRPLRLIYHVAEKETLLAWVTSKFELYTCLSPLVTKAGAILVVTKLLRWVKKEEDRLFIRYPPKYSTPPATSTDQAAHNGLFTGL

SEQ ID NO: 52824 - protein, 110 aa, Homo sapiens
  Payload ID: 10522
  Gene Symbol: MON1B
  Gene Name: MON1 secretory trafficking family member B
  ENSP ID: ENSP00000455376
MEVGGDTAAPAPGGAEDLEDTQFPSEEAREGGGVHAVPPDPEDEGLEETGSKDKDQPPSPSPPPQSEALSSTSRLWSPAAPENSPTCSPESSSGGQGGDPSDEEWRSQRK

SEQ ID NO: 52825 - protein, 119 aa, Homo sapiens
  Payload ID: 10522
  Gene Symbol: MON1B
  Gene Name: MON1 secretory trafficking family member B
  ENSP ID: ENSP00000455641
MEVGGDTAAPAPGGAEDLEDTQFPSEEAREGGGVHAVPPDPEDEGLEETGAPFQDPRTRTSHPAHHHRPSQRPCQAPLGSGVLQPLRIVPHVALRVALEARAGTPVMRSGAASGSMCLC

SEQ ID NO: 52826 - protein, 167 aa, Homo sapiens
  Payload ID: 10522
  Gene Symbol: MON1B
  Gene Name: MON1 secretory trafficking family member B
  ENSP ID: ENSP00000456038
MEVGGDTAAPAPGGAEDLEDTQFPSEEAREGGGVHAVPPDPEDEGLEETGSKDKDQPPSPSPPPQSEALSSTSRLWSPAAPENSPTCSPESSSGGQGGDPSDEEWRSQRKHVFVLSEAGKPIYSRYGSVEALSATMGVMTALVSFVQSAGDAIRAIYAEDHKLVFLQ

SEQ ID NO: 52827 - protein, 101 aa, Homo sapiens
  Payload ID: 10522
  Gene Symbol: MON1B
  Gene Name: MON1 secretory trafficking family member B
  ENSP ID: ENSP00000457542
MEVGGDTAAPAPGGAEDLEDTQFPSEEAREGGGVHAVPPDPEDEGLEETGSKDKDQPPSPSPPPQSEALSSTSRLWSPAAPENSPTCSPESSSGGQGGDPS

SEQ ID NO: 52828 - protein, 255 aa, Homo sapiens
  Payload ID: 10522
  Gene Symbol: MON1B
  Gene Name: MON1 secretory trafficking family member B
  ENSP ID: ENSP00000457858
MEVGGDTAAPAPGGAEDLEDTQFPSEEAREGGGVHAVPPDPEDEGLEETGSKDKDQPPSPSPPPQSEALSSTSRLWSPAAPENSPTCSPESSSGGQGGDPSDEEWRSQRKHVFVLSEAGKPIYSRYGSVEALSATMGVMTALVSFVQSAGDAIRAIYAEDHKLVFLQQGPLLLVAMSRTSQSAAQLRGELLAVHAQIVSTLTRASVARIFAHKQNYDLRRLLAGSERTLDRLLDSMEQDPGALLLGAVRCVPLAR

SEQ ID NO: 52829 - protein, 1711 aa, Homo sapiens
  Payload ID: 10523
  Gene Symbol: MON2
  Gene Name: MON2 homolog, regulator of endosome-to-Golgi trafficking
  Uniprot ID: Q7Z3U7
  ENSP ID: ENSP00000377249
MSGTSSPEAVKKLLENMQSDLRALSLECKKKFPPVKEAAESGIIKVKTIAARNTEILAALKENSSEVVQPFLMGCGTKEPKITQLCLAAIQRLMSHEVVSETAAGNIINMLWQLMENSLEELKLLQTVLVLLTTNTVVHDEALSKAIVLCFRLHFTKDNITNNTAAATVRQVVTVVFERMVAEDERHRDIIEQPVLVQGNSNRRSVSTLKPCAKDAYMLFQDLCQLVNADAPYWLVGMTEMTRTFGLELLESVLNDFPQVFLQHQEFSFLLKERVCPLVIKLFSPNIKFRQGSSTSSSPAPVEKPYFPICMRLLRVVSVLIKQFYSLLVTECEIFLSLLVKFLDADKPQWLRAVAVESIHRFCVQPQLLRSFCQSYDMKQHSTKVFRDIVNALGSFIQSLFLVPPTGNPATSNQAGNNNLGGSVSAPANSGMVGIGGGVTLLPAFEYRGTWIPILTITVQGSAKATYLEMLDKVEPPTIPEGYAMSVAFHCLLDLVRGITSMIEGELGELETECQTTTEEGSSPTQSTEQQDLQSTSDQMDKEIVSRAVWEEMVNACWCGLLAALSLLLDASTDEAATENILKAELTMAALCGRLGLVTSRDAFITAICKGSLPPHYALTVLNTTTAATLSNKSYSVQGQSVMMISPSSESHQQVVAVGQPLAVQPQGTVMLTSKNIQCMRTLLNLAHCHGAVLGTSWQLVLATLQHLVWILGLKPSSGGALKPGRAVEGPSTVLTTAVMTDLPVISNILSRLFESSQYLDDVSLHHLINALCSLSLEAMDMAYGNNKEPSLFAVAKLLETGLVNMHRIEILWRPLTGHLLEVCQHPNSRMREWGAEALTSLIKAGLTFNHDPPLSQNQRLQLLLLNPLKEMSNINHPDIRLKQLECVLQILQSQGDSLGPGWPLVLGVMGAIRNDQGESLIRTAFQCLQLVVTDFLPTMPCTCLQIVVDVAGSFGLHNQELNISLTSIGLLWNISDYFFQRGETIEKELNKEEAAQQKQAEEKGVVLNRPFHPAPPFDCLWLCLYAKLGELCVDPRPAVRKSAGQTLFSTIGAHGTLLQHSTWHTVIWKVLFHLLDRVRESSTTADKEKIESGGGNILIHHSRDTAEKQWAETWVLTLAGVARIFNTRRYLLQPLGDFSRAWDVLLDHIQSAALSKNNEVSLAALKSFQEILQIVSPVRDSDKPETPPVVNVPVPVLIGPISGMSRPFVRTDSIGEKLGRYSSSEPPIVTDELEDLNLWWAAWNTWYRIGSESTKPPITFDKLTFIPSQPFLTALIQIFPALYQHIKTGFNMDDLQKLGVILHSAISVPISSDASPFILPSYTEAVLTSLQEAVLTALDVLQKAICVGPENMQIMYPAIFDQLLAFVEFSCKPPQYGQLETKHIANAKYNQAEWVALNYVPFAERSLEVVVDLYQKTACHKAVVNEKVLQNIIKTLRVPLSLKYSCPSESTWKLAVSSLLRVLSIGLPVARQHASSGKFDSMWPELANTFEDFLFTKSIPPDNLSIQEFQRNENIDVEVVQLISNEILPYANFIPKEFVGQIMTMLNKGSIHSQSSSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENVDGNTWAQVIALYPTLVECITCSSSEVCSALKEALVPFKDFMQPPASRVQNGES

SEQ ID NO: 52830 - protein, 1717 aa, Homo sapiens
  Payload ID: 10523
  Gene Symbol: MON2
  Gene Name: MON2 homolog, regulator of endosome-to-Golgi trafficking
  Uniprot ID: Q7Z3U7
  ENSP ID: ENSP00000377250
MSGTSSPEAVKKLLENMQSDLRALSLECKKKFPPVKEAAESGIIKVKTIAARNTEILAALKENSSEVVQPFLMGCGTKEPKITQLCLAAIQRLMSHEVVSETAAGNIINMLWQLMENSLEELKLLQTVLVLLTTNTVVHDEALSKAIVLCFRLHFTKDNITNNTAAATVRQVVTVVFERMVAEDERHRDIIEQPVLVQGNSNRRSVSTLKPCAKDAYMLFQDLCQLVNADAPYWLVGMTEMTRTFGLELLESVLNDFPQVFLQHQEFSFLLKERVCPLVIKLFSPNIKFRQGSSTSSSPAPVEKPYFPICMRLLRVVSVLIKQFYSLLVTECEIFLSLLVKFLDADKPQWLRAVAVESIHRFCVQPQLLRSFCQSYDMKQHSTKVFRDIVNALGSFIQSLFLVPPTGNPATSNQAGNNNLGGSVSAPANSGMVGIGGGVTLLPAFEYRGTWIPILTITVQGSAKATYLEMLDKVEPPTIPEGYAMSVAFHCLLDLVRGITSMIEGELGELETECQTTTEEGSSPTQSTEQQDLQSTSDQMDKEIVSRAVWEEMVNACWCGLLAALSLLLDASTDEAATENILKAELTMAALCGRLGLVTSRDAFITAICKGSLPPHYALTVLNTTTAATLSNKSYSVQGQSVMMISPSSESHQQVVAVGQPLAVQPQGTVMLTSKNIQCMRTLLNLAHCHGAVLGTSWQLVLATLQHLVWILGLKPSSGGALKPGRAVEGPSTVLTTAVMTDLPVISNILSRLFESSQYLDDVSLHHLINALCSLSLEAMDMAYGNNKEPSLFAVAKLLETGLVNMHRIEILWRPLTGHLLEVCQHPNSRMREWGAEALTSLIKAGLTFNHDPPLSQNQRLQLLLLNPLKEMSNINHPDIRLKQLECVLQILQSQGDSLGPGWPLVLGVMGAIRNDQGESLIRTAFQCLQLVVTDFLPTMPCTCLQIVVDVAGSFGLHNQELNISLTSIGLLWNISDYFFQRGETIEKELNKEEAAQQKQAEEKGVVLNRPFHPAPPFDCLWLCLYAKLGELCVDPRPAVRKSAGQTLFSTIGAHGTLLQHSTWHTVIWKVLFHLLDRVRESSTTADKEKIESGGGNILIHHSRDTAEKQWAETWVLTLAGVARIFNTRRYLLQPLGDFSRAWDVLLDHIQSAALSKNNEVSLAALKSFQEILQIVSPVRDSDKPETPPVVNVPVPVLIGPISGMSRPFVRTDSIGEKLGRYSSSEPPIVTDELEDLNLWWAAWNTWYRIGSESTKPPITFDKLTFIPSQPFLTALIQIFPALYQHIKTGFNMDDLQKLGVILHSAISVPISSDASPFILPSYTEAVLTSLQEAVLTALDVLQKAICVGPENMQIMYPAIFDQLLAFVEFSCKPPQYGQLETKHIANAKYNQIQLFAPAEWVALNYVPFAERSLEVVVDLYQKTACHKAVVNEKVLQNIIKTLRVPLSLKYSCPSESTWKLAVSSLLRVLSIGLPVARQHASSGKFDSMWPELANTFEDFLFTKSIPPDNLSIQEFQRNENIDVEVVQLISNEILPYANFIPKEFVGQIMTMLNKGSIHSQSSSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENVDGNTWAQVIALYPTLVECITCSSSEVCSALKEALVPFKDFMQPPASRVQNGES

SEQ ID NO: 52831 - protein, 43 aa, Homo sapiens
  Payload ID: 10523
  Gene Symbol: MON2
  Gene Name: MON2 homolog, regulator of endosome-to-Golgi trafficking
  ENSP ID: ENSP00000446626
MSGTSSPEAVKKLLENMQSDLRALSLECKKKFPPVKEVQMRGI

SEQ ID NO: 52832 - protein, 1072 aa, Homo sapiens
  Payload ID: 10523
  Gene Symbol: MON2
  Gene Name: MON2 homolog, regulator of endosome-to-Golgi trafficking
  ENSP ID: ENSP00000446635
MSGTSSPEAVKKLLENMQSDLRALSLECKKKFPPVKEAAESGIIKVKTIAARNTEILAALKENSSEVVQPFLMGCGTKEPKITQLCLAAIQRLMSHEVVSETAAGNIINMLWQLMENSLEELKLLQTVLVLLTTNTVVHDEALSKAIVLCFRLHFTKDNITNNTAAATVRQVVTVVFERMVAEDERHRDIIEQPVLVQGNSNRRSVSTLKPCAKDAYMLFQDLCQLVNADAPYWLVGMTEMTRTFGLELLESVLNDFPQVFLQHQEFSFLLKERVCPLVIKLFSPNIKFRQGSSTSSSPAPVEKPYFPICMRLLRVVSVLIKQFYSLLVTECEIFLSLLVKFLDADKPQWLRAVAVESIHRFCVQPQLLRSFCQSYDMKQHSTKVFRDIVNALGSFIQSLFLVPPTGNPATSNQAGNNNLGGSVSAPANSGMVGIGGGVTLLPAFEYRGTWIPILTITVQGSAKATYLEMLDKVEPPTIPEGYAMSVAFHCLLDLVRGITSMIEGELGELETECQTTTEEGSSPTQSTEQQDLQSTSDQMDKEIVSRAVWEEMVNACWCGLLAALSLLLDASTDEAATENILKAELTMAALCGRLGLVTSRDAFITAICKGSLPPHYALTVLNTTTAATLSNKSYSVQGQSVMMISPSSESHQQVVAVGQPLAVQPQGTVMLTSKNIQCMRTLLNLAHCHGAVLGTSWQLVLATLQHLVWILGLKPSSGGALKPGRAVEGPSTVLTTAVMTDLPVISNILSRLFESSQYLDDVSLHHLINALCSLSLEAMDMAYGNNKEPSLFAVAKLLETGLVNMHRIEILWRPLTGHLLEVCQHPNSRMREWGAEALTSLIKAGLTFNHDPPLSQNQRLQLLLLNPLKEMSNINHPDIRLKQLECVLQILQSQGDSLGPGWPLVLGVMGAIRNDQGESLIRTAFQCLQLVVTDFLPTMPCTCLQIVVDVAGSFGLHNQELNISLTSIGLLWNISDYFFQRGETIEKELNKEEAAQQKQAEEKGVVLNRPFHPAPPFDCLWLCLYAKLGELCVDPRPAVRKSAGQTLFSTIGAHGTLLQHSTWHTVIWKVL

SEQ ID NO: 52833 - protein, 1675 aa, Homo sapiens
  Payload ID: 10523
  Gene Symbol: MON2
  Gene Name: MON2 homolog, regulator of endosome-to-Golgi trafficking
  Uniprot ID: Q7Z3U7
  ENSP ID: ENSP00000447407
MSGTSSPEAVKKLLENMQSDLRALSLECKKKFPPVKEAAESGIIKVKTIAARNTEILAALKENSSEVVQPFLMGCGTKEPKITQLCLAAIQRLMSHEVVSETAAGNIINMLWQLMENSLEELKLLQTVLVLLTTNTVVHDEALSKAIVLCFRLHFTKDNITNNTAAATVRQVVTVVFERMVAEDERHRDIIEQPVLVQGNSNRRSVSTLKPCAKDAYMLFQDLCQLVNADAPYWLVGMTEMTRTFGLELLESVLNDFPQVFLQHQEFSFLLKERVCPLVIKLFSPNIKFRQGSSTSSSPAPVEKPYFPICMRLLRVVSVLIKQFYSLLVTECEIFLSLLVKFLDADKPQWLRAVAVESIHRFCVQPQLLRSFCQSYDMKQHSTKVFRDIVNALGSFIQSLFLVPPTGNPATSNQAGNNNLGGSVSAPANSGMVGIGGGVTLLPAFEYRGTWIPILTITVQGSAKATYLEMLDKVEPPTIPEGYAMSVAFHCLLDLVRGITSMIEGELGELETECQTTTEEGSSPTQSTEQQDLQSTSDQMDKEIVSRAVWEEMVNACWCGLLAALSLLLDASTDEAATENILKAELTMAALCGRLGLVTSRDAFITAICKGSLPPHYALTVLNTTTAATLSNKSYSVQGQSVMMISPSSESHQQVVAVGQPLAVQPQGTVMLTSKNIQCMRTLLNLAHCHGAVLGTSWQLVLATLQHLVWILGLKPSSGGALKPGRAVEGPSTVLTTAVMTDLPVISNILSRLFESSQYLDDVSLHHLINALCSLSLEAMDMAYGNNKEPSLFAVAKLLETGLVNMHRIEILWRPLTGHLLEVCQHPNSRMREWGAEALTSLIKAGLTFNHDPPLSQNQRLQLLLLNPLKEMSNINHPDIRLKQLECVLQILQSQGDSLGPGWPLVLGVMGAIRNDQGESLIRTAFQCLQLVVTDFLPTMPCTCLQIVVDVAGSFGLHNQELNISLTSIGLLWNISDYFFQRGETIEKELNKEEAAQQKQAEEKGVVLNRPFHPAPPFDCLWLCLYAKLGELCVDPRPAVRKSAGQTLFSTIGAHGTLLQHSTWHTVIWKVLFHLLDRVRESSTTADKEKIESGGGNILIHHSRDTAEKQWAETWVLTLAGVARIFNTRRYLLQPLGDFSRAWDVLLDHIQSAALSKNNEVSLAALKSFQEILQIVSPVRDSDKPETPPVVNVPVPVLIGPISGMSRPFVRTDSIGEKLGRYSSSEPPIVTDELEDLNLWWAAWNTWYRIGSESTKPPITFDKLTFIPSQPFLTALIQIFPALYQHIKTGFNMDDLQKLGVILHSAISVPISSDASPFILPSYTEAVLTSLQEAVLTALDVLQKAICVGPENMQIMYPAIFDQLLAFVEFSCKPPQYGQLETKHIANAKYNQIQLFAPAEWVALNYVPFAERSLEVVVDLYQKTACHKAVVNEKVLQNIIKTLRVPLSLKYSCPSESTWKLAVSSLLRVLSIGLPVARQHASSGKFDSMWPELANTFEDFLFTKSIPPDNLSIQEFQRNENIDVEVVQLISNEILPYANFIPKEFVGQIMTMLNKGSIHSQSSSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENACISLFGIPPYF

SEQ ID NO: 52834 - protein, 1688 aa, Homo sapiens
  Payload ID: 10523
  Gene Symbol: MON2
  Gene Name: MON2 homolog, regulator of endosome-to-Golgi trafficking
  Uniprot ID: Q7Z3U7
  ENSP ID: ENSP00000449215
MSGTSSPEAVKKLLENMQSDLRALSLECKKKFPPVKEAAESGIIKVKTIAARNTEILAALKENSSEVVQPFLMGCGTKEPKITQLCLAAIQRLMSHEVVSETAAGNIINMLWQLMENSLEELKLLQTVLVLLTTNTVVHDEALSKAIVLCFRLHFTKDNITNNTAAATVRQVVTVVFERMVAEDERHRDIIEQPVLVQGNSNRRSVSTLKPCAKDAYMLFQDLCQLVNADAPYWLVGMTEMTRTFGLELLESVLNDFPQVFLQHQEFSFLLKERVCPLVIKLFSPNIKFRQGSSTSSSPAPVEKPYFPICMRLLRVVSVLIKQFYSLLVTECEIFLSLLVKFLDADKPQWLRAVAVESIHRFCVQPQLLRSFCQSYDMKQHSTKVFRDIVNALGSFIQSLFLVPPTGNPATSNQAGNNNLGGSVSAPANSGMVGIGGGVTLLPAFEYRGTWIPILTITVQGSAKATYLEMLDKVEPPTIPEGYAMSVAFHCLLDLVRGITSMIEGELGELETECQTTTEEGSSPTQSTEQQDLQSTSDQMDKEIVSRAVWEEMVNACWCGLLAALSLLLDASTDEAATENILKAELTMAALCGRLGLVTSRDAFITAICKAYSVQGQSVMMISPSSESHQQVVAVGQPLAVQPQGTVMLTSKNIQCMRTLLNLAHCHGAVLGTSWQLVLATLQHLVWILGLKPSSGGALKPGRAVEGPSTVLTTAVMTDLPVISNILSRLFESSQYLDDVSLHHLINALCSLSLEAMDMAYGNNKEPSLFAVAKLLETGLVNMHRIEILWRPLTGHLLEVCQHPNSRMREWGAEALTSLIKAGLTFNHDPPLSQNQRLQLLLLNPLKEMSNINHPDIRLKQLECVLQILQSQGDSLGPGWPLVLGVMGAIRNDQGESLIRTAFQCLQLVVTDFLPTMPCTCLQIVVDVAGSFGLHNQELNISLTSIGLLWNISDYFFQRGETIEKELNKEEAAQQKQAEEKGVVLNRPFHPAPPFDCLWLCLYAKLGELCVDPRPAVRKSAGQTLFSTIGAHGTLLQHSTWHTVIWKVLFHLLDRVRESSTTADKEKIESGGGNILIHHSRDTAEKQWAETWVLTLAGVARIFNTRRYLLQPLGDFSRAWDVLLDHIQSAALSKNNEVSLAALKSFQEILQIVSPVRDSDKPETPPVVNVPVPVLIGPISGMSRPFVRTDSIGEKLGRYSSSEPPIVTDELEDLNLWWAAWNTWYRIGSESTKPPITFDKLTFIPSQPFLTALIQIFPALYQHIKTGFNMDDLQKLGVILHSAISVPISSDASPFILPSYTEAVLTSLQEAVLTALDVLQKAICVGPENMQIMYPAIFDQLLAFVEFSCKPPQYGQLETKHIANAKYNQAEWVALNYVPFAERSLEVVVDLYQKTACHKAVVNEKVLQNIIKTLRVPLSLKYSCPSESTWKLAVSSLLRVLSIGLPVARQHASSGKFDSMWPELANTFEDFLFTKSIPPDNLSIQEFQRNENIDVEVVQLISNEILPYANFIPKEFVGQIMTMLNKGSIHSQSSSFTEAEIDIRLREEFSKMCFETLLQFSFSNKVTTPQEGYISRMALSVLLKRSQDVLHRYIEDERLSGKCPLPRQQVTEIIFVLKAVSTLIDSLKKTQPENVDGNTWAQVIALYPTLVECITCSSSEVCSALKEALVPFKDFMQPPASRVQNGES

SEQ ID NO: 52835 - protein, 59 aa, Homo sapiens
  Payload ID: 10523
  Gene Symbol: MON2
  Gene Name: MON2 homolog, regulator of endosome-to-Golgi trafficking
  ENSP ID: ENSP00000450136
MSGTSSPEAVKKLLENMQSDLRALSLECKKKFPPVKEAAESGIIKVKTIAARNTEILAG

SEQ ID NO: 52836 - protein, 335 aa, Homo sapiens
  Payload ID: 10524
  Gene Symbol: MOGAT1
  Gene Name: monoacylglycerol O-acyltransferase 1
  Uniprot ID: Q96PD6
  ENSP ID: ENSP00000406674
MKVEFAPLNIQLARRLQTVAVLQWVLKYLLLGPMSIGITVMLIIHNYLFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVMSVGLVSVSKKSVSYMVSKEGGGNISVIVLGGAKESLDAHPGKFTLFIRQRKGFVKIALTHGASLVPVVSFGENELFKQTDNPEGSWIRTVQNKLQKIMGFALPLFHARGVFQYNFGLMTYRKAIHTVVGRPIPVRQTLNPTQEQIEELHQTYMEELRKLFEEHKGKYGIPEHETLVLK

SEQ ID NO: 52837 - protein, 334 aa, Homo sapiens
  Payload ID: 10525
  Gene Symbol: MOGAT2
  Gene Name: monoacylglycerol O-acyltransferase 2
  Uniprot ID: Q3SYC2
  ENSP ID: ENSP00000198801
MVEFAPLFMPWERRLQTLAVLQFVFSFLALAEICTVGFIALLFTRFWLLTVLYAAWWYLDRDKPRQGGRHIQAIRCWTIWKYMKDYFPISLVKTAELDPSRNYIAGFHPHGVLAVGAFANLCTESTGFSSIFPGIRPHLMMLTLWFRAPFFRDYIMSAGLVTSEKESAAHILNRKGGGNLLGIIVGGAQEALDARPGSFTLLLRNRKGFVRLALTHGAPLVPIFSFGENDLFDQIPNSSGSWLRYIQNRLQKIMGISLPLFHGRGVFQYSFGLIPYRRPITTVVGKPIEVQKTLHPSEEEVNQLHQRYIKELCNLFEAHKLKFNIPADQHLEFC

SEQ ID NO: 52838 - protein, 252 aa, Homo sapiens
  Payload ID: 10525
  Gene Symbol: MOGAT2
  Gene Name: monoacylglycerol O-acyltransferase 2
  Uniprot ID: Q3SYC2
  ENSP ID: ENSP00000436283
MKDYFPISLVKTAELDPSRNYIAGFHPHGVLAVGAFANLCTESTGFSSIFPGIRPHLMMLTLWFRAPFFRDYIMSAGLVTSEKESAAHILNRKGGGNLLGIIVGGAQEALDARPGSFTLLLRNRKGFVRLALTHGAPLVPIFSFGENDLFDQIPNSSGSWLRYIQNRLQKIMGISLPLFHGRGVFQYSFGLIPYRRPITTVVGKPIEVQKTLHPSEEEVNQLHQRYIKELCNLFEAHKLKFNIPADQHLEFC

SEQ ID NO: 52839 - protein, 284 aa, Homo sapiens
  Payload ID: 10525
  Gene Symbol: MOGAT2
  Gene Name: monoacylglycerol O-acyltransferase 2
  Uniprot ID: Q3SYC2
  ENSP ID: ENSP00000436537
MVEFAPLFMPWERRLQTLAVLQFVFSFLALAEICTVGFIALLFTRFWLLTVLYAAWWYLDRDKPRQGGRHIQAIRCWTIWKYMKDYFPISLVKTAELDPSRNYIAGFHPHGVLAVGAFANLCTESTGFSSIFPGIRPHLMMLTLWFRAPFFRDYIMSAGLVTSEKESAAHILNRKGGGNLLGIIVGGAQEALDARPGSFTLLLRNRKGFVRLALTHGYQASGKSTLGSVGNWQGFYFGGKMAETNADSILVEIFSPFTIKIIFWCLMPKYLEKFPQRRLSDLRN

SEQ ID NO: 52840 - protein, 341 aa, Homo sapiens
  Payload ID: 10526
  Gene Symbol: MOGAT3
  Gene Name: monoacylglycerol O-acyltransferase 3
  Uniprot ID: Q86VF5
  ENSP ID: ENSP00000223114
MGVATTLQPPTTSKTLQKQHLEAVGAYQYVLTFLFMGPFFSLLVFVLLFTSLWPFSVFYLVWLYVDWDTPNQGGRRSEWIRNRAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKLMGFSPCIFWGRGLFSATSWGLLPFAVPITTVVGRPIPVPQRLHPTEEEVNHYHALYMTALEQLFEEHKESCGVPASTCLTFI

SEQ ID NO: 52841 - protein, 281 aa, Homo sapiens
  Payload ID: 10526
  Gene Symbol: MOGAT3
  Gene Name: monoacylglycerol O-acyltransferase 3
  Uniprot ID: Q86VF5
  ENSP ID: ENSP00000368734
MGVATTLQPPTTSKTLQKQHLEAVGAYQYVLTFLFMGPFFSLLVFVLLFTSLWPFSVFYLVWLYVDWDTPNQGGRRSEWIRNRAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGGPPHPRPPAPPPHRGGSQSLSRPLHDGPGAALRGAQGKLWGPRFHLPHLHLGLAAAFR

SEQ ID NO: 52842 - protein, 344 aa, Homo sapiens
  Payload ID: 10526
  Gene Symbol: MOGAT3
  Gene Name: monoacylglycerol O-acyltransferase 3
  Uniprot ID: Q86VF5
  ENSP ID: ENSP00000403756
MGVATTLQPPTTSKTLQKQHLEAVGAYQYVLTFLFMGPFFSLLVFVLLFTSLWPFSVFYLVWLYVDWDTPNQGGRRSEWIRNRAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKLMGFSPCIFWGRGLFSATSWGLLPFAVPITTVGECPPPGGRPPAAAWASGIPRPPVSLSLQWAAPSPSPSASTPPRRKSITITPST

SEQ ID NO: 52843 - protein, 527 aa, Homo sapiens
  Payload ID: 10527
  Gene Symbol: MAOA
  Gene Name: monoamine oxidase A
  Uniprot ID: P21397
  ENSP ID: ENSP00000340684
MENQEKASIAGHMFDVVVIGGGISGLSAAKLLTEYGVSVLVLEARDRVGGRTYTIRNEHVDYVDVGGAYVGPTQNRILRLSKELGIETYKVNVSERLVQYVKGKTYPFRGAFPPVWNPIAYLDYNNLWRTIDNMGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIMTQYGRVIRQPVGRIFFAGTETATKWSGYMEGAVEAGERAAREVLNGLGKVTEKDIWVQEPESKDVPAVEITHTFWERNLPSVSGLLKIIGFSTSVTALGFVLYKYKLLPRS

SEQ ID NO: 52844 - protein, 394 aa, Homo sapiens
  Payload ID: 10527
  Gene Symbol: MAOA
  Gene Name: monoamine oxidase A
  Uniprot ID: P21397
  ENSP ID: ENSP00000440846
MGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIMTQYGRVIRQPVGRIFFAGTETATKWSGYMEGAVEAGERAAREVLNGLGKVTEKDIWVQEPESKDVPAVEITHTFWERNLPSVSGLLKIIGFSTSVTALGFVLYKYKLLPRS

SEQ ID NO: 52845 - protein, 520 aa, Homo sapiens
  Payload ID: 10528
  Gene Symbol: MAOB
  Gene Name: monoamine oxidase B
  Uniprot ID: P27338
  ENSP ID: ENSP00000367309
MSNKCDVVVVGGGISGMAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGILTQYGRVLRQPVDRIYFAGTETATHWSGYMEGAVEAGERAAREILHAMGKIPEDEIWQSEPESVDVPAQPITTTFLERHLPSVPGLLRLIGLTTIFSATALGFLAHKRGLLVRV

SEQ ID NO: 52846 - protein, 238 aa, Homo sapiens
  Payload ID: 10529
  Gene Symbol: MMD
  Gene Name: monocyte to macrophage differentiation-associated
  Uniprot ID: Q15546
  ENSP ID: ENSP00000262065
MRFKNRFQRFMNHRAPANGRYKPTCYEHAANCYTHAFLIVPAIVGSALLHRLSDDCWEKITAWIYGMGLCALFIVSTVFHIVSWKKSHLRTVEHCFHMCDRMVIYFFIAASYAPWLNLRELGPLASHMRWFIWLMAAGGTIYVFLYHEKYKVVELFFYLTMGFSPALVVTSMNNTDGLQELACGGLIYCLGVVFFKSDGIIPFAHAIWHLFVATAAAVHYYAIWKYLYRSPTDFMRHL

SEQ ID NO: 52847 - protein, 147 aa, Homo sapiens
  Payload ID: 10529
  Gene Symbol: MMD
  Gene Name: monocyte to macrophage differentiation-associated
  ENSP ID: ENSP00000459202
MRFKNRFQRFMNHRAPANGRYKPTCYEHAANCYTHAFLIVPAIVGSALLHRLSDDCWEKITAWIYGMGLCALFIVSTVFHIVSWKKSHLRLNLRELGPLASHMRWFIWLMAAGGTIYVFLYHEKYKVVELFFYLTMGFSPALVVTSM

SEQ ID NO: 52848 - protein, 246 aa, Homo sapiens
  Payload ID: 10530
  Gene Symbol: MMD2
  Gene Name: monocyte to macrophage differentiation-associated 2
  Uniprot ID: Q8IY49
  ENSP ID: ENSP00000384141
MFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERYKLVELLCYVVMGFFPALVILSMPNTEGIWELVTGGVFYCLGMVFFKSDGRIPFAHAIWHLFVAFGAGTHYYAIWRYLYLPSTLQTKVSK

SEQ ID NO: 52849 - protein, 270 aa, Homo sapiens
  Payload ID: 10530
  Gene Symbol: MMD2
  Gene Name: monocyte to macrophage differentiation-associated 2
  Uniprot ID: Q8IY49
  ENSP ID: ENSP00000384690
MFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERTGSCVQFLRGEACPKAGTACLPARYKLVELLCYVVMGFFPALVILSMPNTEGIWELVTGGVFYCLGMVFFKSDGRIPFAHAIWHLFVAFGAGTHYYAIWRYLYLPSTLQTKVSK

SEQ ID NO: 52850 - protein, 193 aa, Homo sapiens
  Payload ID: 10530
  Gene Symbol: MMD2
  Gene Name: monocyte to macrophage differentiation-associated 2
  Uniprot ID: Q8IY49
  ENSP ID: ENSP00000385963
MFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERYKLVELLCYVVMGFFPALVILSMAGKLRPGMTCLKRQ

SEQ ID NO: 52851 - protein, 193 aa, Homo sapiens; identical to SEQ ID NO: 52850
  Payload ID: 10530
  Gene Symbol: MMD2
  Gene Name: monocyte to macrophage differentiation-associated 2
  Uniprot ID: Q8IY49
  ENSP ID: ENSP00000484193

SEQ ID NO: 52852 - protein, 313 aa, Homo sapiens
  Payload ID: 10531
  Gene Symbol: MGLL
  Gene Name: monoglyceride lipase
  ENSP ID: ENSP00000265052
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 52853 - protein, 277 aa, Homo sapiens
  Payload ID: 10531
  Gene Symbol: MGLL
  Gene Name: monoglyceride lipase
  ENSP ID: ENSP00000381173
MQTRFRRIFPWKDASTKRMPEFIHFSPLKPYKGREWEKAGSEHVLETHLLPVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 52854 - protein, 303 aa, Homo sapiens
  Payload ID: 10531
  Gene Symbol: MGLL
  Gene Name: monoglyceride lipase
  Uniprot ID: Q99685
  ENSP ID: ENSP00000381176
MPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 52855 - protein, 303 aa, Homo sapiens; identical to SEQ ID NO: 52854
  Payload ID: 10531
  Gene Symbol: MGLL
  Gene Name: monoglyceride lipase
  Uniprot ID: Q99685
  ENSP ID: ENSP00000402798

SEQ ID NO: 52856 - protein, 283 aa, Homo sapiens
  Payload ID: 10531
  Gene Symbol: MGLL
  Gene Name: monoglyceride lipase
  Uniprot ID: Q99685
  ENSP ID: ENSP00000404146
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 52857 - protein, 209 aa, Homo sapiens
  Payload ID: 10531
  Gene Symbol: MGLL
  Gene Name: monoglyceride lipase
  ENSP ID: ENSP00000417060
  MOD_RES (1)..(1): Any amino acid
XLQGGAIAILTAAERPGHFAGMVLISPLVLANPESATTFKDYSRILKHLMEKASRMLKFWIPRPFWVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 52858 - protein, 77 aa, Homo sapiens
  Payload ID: 10531
  Gene Symbol: MGLL
  Gene Name: monoglyceride lipase
  ENSP ID: ENSP00000417489
MPEESSPRRTPQSIPYQDLPHLVNADGQYLFCRYWKPTGTPKALIFVSHGAGEHSGRYEELARMLMGLDLLVFAHDH

SEQ ID NO: 52859 - protein, 89 aa, Homo sapiens
  Payload ID: 10531
  Gene Symbol: MGLL
  Gene Name: monoglyceride lipase
  ENSP ID: ENSP00000417689
MLMGLDLLVFAHDHVGHGQSEGERMVVSDFHVFVRDVLQHVDSMQKDYPGLPVFLLGHSMGGAIAILTAAERPGHFAGMVLISPLVLAN

SEQ ID NO: 52860 - protein, 197 aa, Homo sapiens
  Payload ID: 10531
  Gene Symbol: MGLL
  Gene Name: monoglyceride lipase
  ENSP ID: ENSP00000419340
PVGHGQSEGERMVVSDFHVFVRDVLQHVDSMQKDYPGLPVFLLGHSMGGAIAILTAAERPGHFAGMVLISPLVLANPESATTFKVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 52861 - protein, 155 aa, Homo sapiens [sequence omitted]

SEQ ID NO: 52862 - protein, 545 aa, Homo sapiens
  Payload ID: 10532
  Gene Symbol: MOXD1
  Gene Name: monooxygenase, DBH-like 1
  Uniprot ID: Q6UVY6
  ENSP ID: ENSP00000336998
MNSFLSVFRYPDFSFPYFPQDYFTNANRELKKDAQQDYHLEYAMENSTHTIIEFTRELHTCDINDKSITDSTVRVIWAYHHEDAGEAGPKYHDSNRGTKSLRLLNPEKTSVLSTALPYFDLVNQDVPIPNKDTTYWCQMFKIPVFQEKHHVIKVEPVIQRGHESLVHHILLYQCSNNFNDSVLESGHECYHPNMPDAFLTCETVIFAWAIGGEGFSYPPHVGLSLGTPLDPHYVLLEVHYDNPTYEEGLIDNSGLRLFYTMDIRKYDAGVIEAGLWVSLFHTIPPGMPEFQSEGHCTLECLEEALEAEKPSGIHVFAVLLHAHLAGRGIRLRHFRKGKEMKLLAYDDDFDFNFQEFQYLKEEQTILPGDNLITECRYNTKDRAEMTWGGLSTRSEMCLSYLLYYPRINLTRCASIPDIMEQLQFIGVKEIYRPVTTWPFIIKSPKQYKNLSFMDAMNKFKWTKKEGLSFNKLVLSLPVNVRCSKTDNAEWSIQGMTALPPDIERPYKAEPLVCGTSSSSSLHRDFSINLLVCLLLLSCTLSTKSL

SEQ ID NO: 52863 - protein, 613 aa, Homo sapiens
  Payload ID: 10532
  Gene Symbol: MOXD1
  Gene Name: monooxygenase, DBH-like 1
  Uniprot ID: Q6UVY6
  ENSP ID: ENSP00000356940
MCCWPLLLLWGLLPGTAAGGSGRTYPHRTLLDSEGKYWLGWSQRGSQIAFRLQVRTAGYVGFGFSPTGAMASADIVVGGVAHGRPYLQDYFTNANRELKKDAQQDYHLEYAMENSTHTIIEFTRELHTCDINDKSITDSTVRVIWAYHHEDAGEAGPKYHDSNRGTKSLRLLNPEKTSVLSTALPYFDLVNQDVPIPNKDTTYWCQMFKIPVFQEKHHVIKVEPVIQRGHESLVHHILLYQCSNNFNDSVLESGHECYHPNMPDAFLTCETVIFAWAIGGEGFSYPPHVGLSLGTPLDPHYVLLEVHYDNPTYEEGLIDNSGLRLFYTMDIRKYDAGVIEAGLWVSLFHTIPPGMPEFQSEGHCTLECLEEALEAEKPSGIHVFAVLLHAHLAGRGIRLRHFRKGKEMKLLAYDDDFDFNFQEFQYLKEEQTILPGDNLITECRYNTKDRAEMTWGGLSTRSEMCLSYLLYYPRINLTRCASIPDIMEQLQFIGVKEIYRPVTTWPFIIKSPKQYKNLSFMDAMNKFKWTKKEGLSFNKLVLSLPVNVRCSKTDNAEWSIQGMTALPPDIERPYKAEPLVCGTSSSSSLHRDFSINLLVCLLLLSCTLSTKSL

SEQ ID NO: 52864 - protein, 115 aa, Homo sapiens
  Payload ID: 10532
  Gene Symbol: MOXD1
  Gene Name: monooxygenase, DBH-like 1
  ENSP ID: ENSP00000376202
MCCWPLLLLWGLLPGTAAGGSGRTYPHRTLLDSEGKYWLGWSQRGSQIAFRLQVRTAGYVGFGFSPTGAMASADIVVGGVAHGRPYLQPCLLVSKTEACDAKCLQQQGNCCRATC

SEQ ID NO: 52865 - protein, 984 aa, Homo sapiens
  Payload ID: 10533
  Gene Symbol: MORC1
  Gene Name: MORC family CW-type zinc finger 1
  Uniprot ID: Q86VD1
  ENSP ID: ENSP00000232603
MDDRYPALQRAQLRLDFIHANSTTHSFLFGALAELLDNARDAGAERLDVFSVDNEKLQGGFMLCFLDDGCGMSPEEASDIIYFGRSKKRLSTLKFIGQYGNGLKSGSMRIGKDFILFTKKEETMTCVFFSQTFCEEESLSEVVVPMPSWLIRTRESVTDDPQKFAMELSIIYKYSPFKTEAELMQQFDVIYGKCGTLLVIYNLKLLLNGEPELDVKTDKEDILMAGALEDFPARWSFRAYTSVLYFNPWMRIFIQAKRVKTKHLCYCLYRPRKYLYVTSSFKGAFKDEVKKAEEAVKIAESILKEAQIKVNQCDRTSLSSAKDVLQRALEDVEAKQKNLKEKQRELKTARTLSLFYGVNVENRSQAGMFIYSNNRLIKMHEKVGSQLKLKSLLGAGVVGIVNIPLEVMEPSHNKQEFLNVQEYNHLLKVMGQYLVQYCKDTGINNRNLTLFCNEFGYQNDIDVEKPLNSFQYQRRQAMGIPFIIQCDLCLKWRVLPSSTNYQEKEFFDIWICANNPNRLENSCHQVECLPSIPLGTMSTISPSKNEKEKQLRESVIKYQNRLAEQQPQPQFIPVDEITVTSTCLTSAHKENTKTQKIRLLGDDLKHESLSSFELSASRRGQKRNIEETDSDVEYISETKIMKKSMEEKMNSQQQRIPVALPENVKLAERSQRSQIANITTVWRAQPTEGCLKNAQAASWEMKRKQSLNFVEECKVLTEDENTSDSDIILVSDKSNTDVSLKQEKKEIPLLNQEKQELCNDVLAMKRSSSLPSWKSLLNVPMEDVNLSSGHIARVSVSGSCKVASSPASSQSTPVKETVRKLKSKLREILLYFFPEHQLPSELEEPALSCELEQCPEQMNKKLKMCFNQIQNTYMVQYEKKIKRKLQSIIYDSNTRGIHNEISLGQCENKRKISEDKLKNLRIKLALLLQKLQLGGPEGDLEQTDTYLEALLKEDNLLFQNNLNKVTIDARHRLPLEKNEKTSEN

SEQ ID NO: 52866 - protein, 963 aa, Homo sapiens
  Payload ID: 10533
  Gene Symbol: MORC1
  Gene Name: MORC family CW-type zinc finger 1
  Uniprot ID: Q86VD1
  ENSP ID: ENSP00000417282
MDDRYPALQRAQLRLDFIHANSTTHSFLFGALAELLDNARDAGAERLDVFSVDNEKLQGGFMLCFLDDGCGMSPEEASDIIYFGRSKKRLSTLKFIGQYGNGLKSGSMRIGKDFILFTKKEETMTCVFFSQTFCEEESLSEVVVPMPSWLIRTRESVTDDPQKFAMELSIIYKYSPFKTEAELMQQFDVIYGKCGTLLVIYNLKLLLNGEPELDVKTDKEDILMAGALEDFPARWSFRAYTSVLYFNPWMRIFIQAKRVKTKHLCYCLYRPRKYLYVTSSFKGAFKDEVKKAEEAVKIAESILKEAQIKVNQCDRTSLSSAKDVLQRALEDVEAKQKNLKEKQRELKTARTLSLFYGVNVENRSQAGMFIYSNNRLIKMHEKVGSQLKLKSLLGAGVVGIVNIPLEVMEPSHNKQEFLNVQEYNHLLKVMGQYLVQYCKDTGINNRNLTLFCNEFGYQNDIDVEKPLNSFQYQRRQAMGIPFIIQCDLCLKWRVLPSSTNYQEKEFFDIWICANNPNRLENSCHQVECLPSIPLGTMSTISPSKNEKEKQLRESVIKYQNRLAEQQPQENTKTQKIRLLGDDLKHESLSSFELSASRRGQKRNIEETDSDVEYISETKIMKKSMEEKMNSQQQRIPVALPENVKLAERSQRSQIANITTVWRAQPTEGCLKNAQAASWEMKRKQSLNFVEECKVLTEDENTSDSDIILVSDKSNTDVSLKQEKKEIPLLNQEKQELCNDVLAMKRSSSLPSWKSLLNVPMEDVNLSSGHIARVSVSGSCKVASSPASSQSTPVKETVRKLKSKLREILLYFFPEHQLPSELEEPALSCELEQCPEQMNKKLKMCFNQIQNTYMVQYEKKIKRKLQSIIYDSNTRGIHNEISLGQCENKRKISEDKLKNLRIKLALLLQKLQLGGPEGDLEQTDTYLEALLKEDNLLFQNNLNKVTIDARHRLPLEKNEKTSEN

SEQ ID NO: 52867 - protein, 970 aa, Homo sapiens
  Payload ID: 10534
  Gene Symbol: MORC2
  Gene Name: MORC family CW-type zinc finger 2
  Uniprot ID: Q9Y6X9
  ENSP ID: ENSP00000215862
MLCFLDDGAGMDPSDAASVIQFGKSAKRTPESTQIGQYGNGLKSGSMRIGKDFILFTKKEDTMTCLFLSRTFHEEEGIDEVIVPLPTWNARTREPVTDNVEKFAIETELIYKYSPFRTEEEVMTQFMKIPGDSGTLVIIFNLKLMDNGEPELDIISNPRDIQMAETSPEGTKPERRSFRAYAAVLYIDPRMRIFIHGHKVQTKRLSCCLYKPRMYKYTSSRFKTRAEQEVKKAEHVARIAEEKAREAESKARTLEVRLGGDLTRDSRVMLRQVQNRAITLRREADVKKRIKEAKQRALKEPKELNFVFGVNIEHRDLDGMFIYNCSRLIKMYEKVGPQLEGGMACGGVVGVVDVPYLVLEPTHNKQDFADAKEYRHLLRAMGEHLAQYWKDIAIAQRGIIKFWDEFGYLSANWNQPPSSELRYKRRRAMEIPTTIQCDLCLKWRTLPFQLSSVEKDYPDTWVCSMNPDPEQDRCEASEQKQKVPLGTFRKDMKTQEEKQKQLTEKIRQQQEKLEALQKTTPIRSQADLKKLPLEVTTRPSTEEPVRRPQRPRSPPLPAVIRNAPSRPPSLPTPRPASQPRKAPVISSTPKLPALAAREEASTSRLLQPPEAPRKPANTLVKTASRPAPLVQQLSPSLLPNSKSPREVPSPKVIKTPVVKKTESPIKLSPATPSRKRSVAVSDEEEVEEEAERRKERCKRGRFVVKEEKKDSNELSDSAGEEDSADLKRAQKDKGLHVEVRVNREWYTGRVTAVEVGKHVVRWKVKFDYVPTDTTPRDRWVEKGSEDVRLMKPPSPEHQSLDTQQEGGEEEVGPVAQQAIAVAEPSTSECLRIEPDTTALSTNHETIDLLVQILRNCLRYFLPPSFPISKKQLSAMNSDELISFPLKEYFKQYEVGLQNLCNSYQSRADSRAKASEESLRTSERKLRETEEKLQKLRTNIVALLQKVQEDIDINTDDELDAYIEDLITKGD

SEQ ID NO: 52868 - protein, 1032 aa, Homo sapiens
  Payload ID: 10534
  Gene Symbol: MORC2
  Gene Name: MORC family CW-type zinc finger 2
  Uniprot ID: Q9Y6X9
  ENSP ID: ENSP00000380763
MAFTNYSSLNRAQLTFEYLHTNSTTHEFLFGALAELVDNARDADATRIDIYAERREDLRGGFMLCFLDDGAGMDPSDAASVIQFGKSAKRTPESTQIGQYGNGLKSGSMRIGKDFILFTKKEDTMTCLFLSRTFHEEEGIDEVIVPLPTWNARTREPVTDNVEKFAIETELIYKYSPFRTEEEVMTQFMKIPGDSGTLVIIFNLKLMDNGEPELDIISNPRDIQMAETSPEGTKPERRSFRAYAAVLYIDPRMRIFIHGHKVQTKRLSCCLYKPRMYKYTSSRFKTRAEQEVKKAEHVARIAEEKAREAESKARTLEVRLGGDLTRDSRVMLRQVQNRAITLRREADVKKRIKEAKQRALKEPKELNFVFGVNIEHRDLDGMFIYNCSRLIKMYEKVGPQLEGGMACGGVVGVVDVPYLVLEPTHNKQDFADAKEYRHLLRAMGEHLAQYWKDIAIAQRGIIKFWDEFGYLSANWNQPPSSELRYKRRRAMEIPTTIQCDLCLKWRTLPFQLSSVEKDYPDTWVCSMNPDPEQDRCEASEQKQKVPLGTFRKDMKTQEEKQKQLTEKIRQQQEKLEALQKTTPIRSQADLKKLPLEVTTRPSTEEPVRRPQRPRSPPLPAVIRNAPSRPPSLPTPRPASQPRKAPVISSTPKLPALAAREEASTSRLLQPPEAPRKPANTLVKTASRPAPLVQQLSPSLLPNSKSPREVPSPKVIKTPVVKKTESPIKLSPATPSRKRSVAVSDEEEVEEEAERRKERCKRGRFVVKEEKKDSNELSDSAGEEDSADLKRAQKDKGLHVEVRVNREWYTGRVTAVEVGKHVVRWKVKFDYVPTDTTPRDRWVEKGSEDVRLMKPPSPEHQSLDTQQEGGEEEVGPVAQQAIAVAEPSTSECLRIEPDTTALSTNHETIDLLVQILRNCLRYFLPPSFPISKKQLSAMNSDELISFPLKEYFKQYEVGLQNLCNSYQSRADSRAKASEESLRTSERKLRETEEKLQKLRTNIVALLQKVQEDIDINTDDELDAYIEDLITKGD

SEQ ID NO: 52869 - protein, 191 aa, Homo sapiens
  Payload ID: 10534
  Gene Symbol: MORC2
  Gene Name: MORC family CW-type zinc finger 2
  ENSP ID: ENSP00000402602
  MOD_RES (1)..(1): Any amino acid
XRWVEKGSEDVRLMKPPSPEHQSLDTQQEGGEEEVGPVAQQAIAVAEPSTSECLRIEPDTTALSTNHETIDLLVQILRNCLRYFLPPSFPISKKQLSAMNSDELISFPLKEYFKQYEVGLQNLCNSYQSRADSRAKASEESLRTSERKLRETEEKLQKLRTNIVALLQKDIDINTDDELDAYIEDLITKGD

SEQ ID NO: 52870 - protein, 89 aa, Homo sapiens
  Payload ID: 10534
  Gene Symbol: MORC2
  Gene Name: MORC family CW-type zinc finger 2
  ENSP ID: ENSP00000412685
LLLCSQQKEYFKQYEVGLQNLCNSYQSRADSRAKASEESLRTSERKLRETEEKLQKLRTNIVALLQKDIDINTDDELDAYIEDLITKGD

SEQ ID NO: 52871 - protein, 939 aa, Homo sapiens
  Payload ID: 10535
  Gene Symbol: MORC3
  Gene Name: MORC family CW-type zinc finger 3
  Uniprot ID: Q14149
  ENSP ID: ENSP00000383333
MAAQPPRGIRLSALCPKFLHTNSTSHTWPFSAVAELIDNAYDPDVNAKQIWIDKTVINDHICLTFTDNGNGMTSDKLHKMLSFGFSDKVTMNGHVPVGLYGNGFKSGSMRLGKDAIVFTKNGESMSVGLLSQTYLEVIKAEHVVVPIVAFNKHRQMINLAESKASLAAILEHSLFSTEQKLLAELDAIIGKKGTRIIIWNLRSYKNATEFDFEKDKYDIRIPEDLDEITGKKGYKKQERMDQIAPESDYSLRAYCSILYLKPRMQIILRGQKVKTQLVSKSLAYIERDVYRPKFLSKTVRITFGFNCRNKDHYGIMMYHRNRLIKAYEKVGCQLRANNMGVGVVGIIECNFLKPTHNKQDFDYTNEYRLTITALGEKLNDYWNEMKVKKNTEYPLNLPVEDIQKRPDQTWVQCDACLKWRKLPDGMDQLPEKWYCSNNPDPQFRNCEVPEEPEDEDLVHPTYEKTYKKTNKEKFRIRQPEMIPRINAELLFRPTALSTPSFSSPKESVPRRHLSEGTNSYATRLLNNHQVPPQSEPESNSLKRRLSTRSSILNAKNRRLSSQFENSVYKGDDDDEDVIILEENSTPKPAVDHDIDMKSEQSHVEQGGVQVEFVGDSEPCGQTGSTSTSSSRCDQGNTAATQTEVPSLVVKKEETVEDEIDVRNDAVILPSCVEAEAKIHETQETTDKSADDAGCQLQELRNQLLLVTEEKENYKRQCHMFTDQIKVLQQRILEMNDKYVKKETCHQSTETDAVFLLESINGKSESPDHMVSQYQQALEEIERLKKQCSALQHVKAECSQCSNNESKSEMDEMAVQLDDVFRQLDKCSIERDQYKSEVELLEMEKSQIRSQCEELKTEVEQLKSTNQQTATDVSTSSNIEESVNHMDGESLKLRSLRVNVGQLLAMIVPDLDLQQVNYDVDVVDEILGQVVEQMSEISST

SEQ ID NO: 52872 - protein, 191 aa, Homo sapiens
  Payload ID: 10535
  Gene Symbol: MORC3
  Gene Name: MORC family CW-type zinc finger 3
  ENSP ID: ENSP00000447562
ETDAVFLLESINGKSESPDHMVSQYQQALEEIERLKKQCSALQHVKAECSQCSNNESKSEMDEMAVQLDDVFRQLDKCSIERDQYKSEVELLEMEKSQIRSQCEELKTEVEQLKSTNQQTATDVSTSSNIEESVNHMDGESLKLRSLRVNVGQLLAMIVPDLDLQQVNYDVDVVDEILGQVVEQMSEISST

SEQ ID NO: 52873 - protein, 191 aa, Homo sapiens; identical to SEQ ID NO: 52872
  Payload ID: 10535
  Gene Symbol: MORC3
  Gene Name: MORC family CW-type zinc finger 3
  ENSP ID: ENSP00000448357

SEQ ID NO: 52874 - protein, 191 aa, Homo sapiens; identical to SEQ ID NO: 52872
  Payload ID: 10535
  Gene Symbol: MORC3
  Gene Name: MORC family CW-type zinc finger 3
  ENSP ID: ENSP00000449467

SEQ ID NO: 52875 - protein, 226 aa, Homo sapiens
  Payload ID: 10535
  Gene Symbol: MORC3
  Gene Name: MORC family CW-type zinc finger 3
  ENSP ID: ENSP00000449966
  MOD_RES (1)..(1): Any amino acid
XETDAVFLLESINGKSESPDHMVSQYQQALEEIERLKKQCSALQHVKAECSQCSNNESKSEMDEMAVQLDDVFRQLDKCSIERDQYKSEVELLEMEKSQIRSQCEELKTEVEQLKSTNQQTATDVSTSSNIEESVNHMDGESLKLRSLRVNVGQLLAMIVPDLDLQQILKYCQDMRLRKCGSQLQTEQLLFNRTTWAFMMSQVFLISHGVPVGSEALGLYCDLNHD

SEQ ID NO: 52876 - protein, 900 aa, Homo sapiens
  Payload ID: 10536
  Gene Symbol: MORC4
  Gene Name: MORC family CW-type zinc finger 4
  Uniprot ID: Q8TE76
  ENSP ID: ENSP00000255495
MLLYRGAPAGPGAPGCGLARPGGGPQAFGIRLSTMSPRYLQSNSSSHTRPFSAIAELLDNAVDPDVSARTVFIDVEEVKNKSCLTFTDDGCGMTPHKLHRMLSFGFTDKVIKKSQCPIGVFGNGFKSGSMRLGKDALVFTKNGGTLTVGLLSQTYLECVQAQAVIVPIVPFNQQNKKMIITEDSLPSLEAILNYSIFNRENDLLAQFDAIPGKKGTRVLIWNIRRNKNGKSELDFDTDQYDILVSDFDTEEKMTGGVTSELPETEYSLRAFCGILYMKPRMKIFLRQKKVTTQMIAKSLANVEYDTYKPTFTNKQVRITFGFSCKNSNQFGIMMYHNNRLIKSFEKVGCQVKPTRGEGVGVIGVIECNFLKPAYNKQDFEYTKEYRLTINALAQKLNAYWKEKTSQDNFETSTVARPIPKVPDQTWVQCDECLKWRKLPGKIDPSMLPARWFCYYNSHPKYRRCSVPEEQELTDEDLCLSKAKKQEQTVEEKKKMPMENENHQVFSNPPKILTVQEMAGLNNKTIGYEGIHSPSVLPSGGEESRSPSLQLKPLDSSVLQFSSKYKWILGEEPVEKRRRLQNEMTTPSLDYSMPAPYRRVEAPVAYPEGENSHDKSSSERSTPPYLFPEYPEASKNTGQNREVSILYPGAKDQRQGSLLPEELEDQMPRLVAEESNRGSTTINKEEVNKGPFVAVVGVAKGVRDSGAPIQLIPFNREELAERRKAVESWNPVPYSVASAAIPAAAIGEKARGYEESEGHNTPKLKNQRELEELKRTTEKLERVLAERNLFQQKVEELEQERNHWQSEFKKVQHELVIYSTQEAEGLYWSKKHMGYRQAEFQILKAELERTKEEKQELKEKLKETETHLEMLQKAQGFGKAYAATYPRQLSPYFCPPSLGAS

SEQ ID NO: 52877 - protein, 937 aa, Homo sapiens
  Payload ID: 10536
  Gene Symbol: MORC4
  Gene Name: MORC family CW-type zinc finger 4
  Uniprot ID: Q8TE76
  ENSP ID: ENSP00000347821
MLLYRGAPAGPGAPGCGLARPGGGPQAFGIRLSTMSPRYLQSNSSSHTRPFSAIAELLDNAVDPDVSARTVFIDVEEVKNKSCLTFTDDGCGMTPHKLHRMLSFGFTDKVIKKSQCPIGVFGNGFKSGSMRLGKDALVFTKNGGTLTVGLLSQTYLECVQAQAVIVPIVPFNQQNKKMIITEDSLPSLEAILNYSIFNRENDLLAQFDAIPGKKGTRVLIWNIRRNKNGKSELDFDTDQYDILVSDFDTEEKMTGGVTSELPETEYSLRAFCGILYMKPRMKIFLRQKKVTTQMIAKSLANVEYDTYKPTFTNKQVRITFGFSCKNSNQFGIMMYHNNRLIKSFEKVGCQVKPTRGEGVGVIGVIECNFLKPAYNKQDFEYTKEYRLTINALAQKLNAYWKEKTSQDNFETSTVARPIPKVPDQTWVQCDECLKWRKLPGKIDPSMLPARWFCYYNSHPKYRRCSVPEEQELTDEDLCLSKAKKQEQTVEEKKKMPMENENHQVFSNPPKILTVQEMAGLNNKTIGYEGIHSPSVLPSGGEESRSPSLQLKPLDSSVLQFSSKYKWILGEEPVEKRRRLQNEMTTPSLDYSMPAPYRRVEAPVAYPEGENSHDKSSSERSTPPYLFPEYPEASKNTGQNREVSILYPGAKDQRQGSLLPEELEDQMPRLVAEESNRGSTTINKEEVNKGPFVAVVGVAKGVRDSGAPIQLIPFNREELAERRKAVESWNPVPYSVASAAIPAAAIGEKARGYEESEGHNTPKLKNQRELEELKRTTEKLERVLAERNLFQQKVEELEQERNHWQSEFKKVQHELVIYSTQEAEGLYWSKKHMGYRQAEFQILKAELERTKEEKQELKEKLKETETHLEMLQKAQVSYRTPEGDDLERALAKLTRLRIHVSYLLTSVLPHLELREIGYDSEQVDGILYTVLEANHILD

SEQ ID NO: 52878 - protein, 38 aa, Homo sapiens
  Payload ID: 10536
  Gene Symbol: MORC4
  Gene Name: MORC family CW-type zinc finger 4
  ENSP ID: ENSP00000474750
  MOD_RES (1)..(1): Any amino acid
XSARTVFIDVEEVKNKSCLTFTDDGCGMTPHKLHRMLS

SEQ ID NO: 52879 - protein, 127 aa, Homo sapiens
  Payload ID: 10537
  Gene Symbol: MRFAP1
  Gene Name: Morf4 family associated protein 1
  Uniprot ID: Q9Y605
  ENSP ID: ENSP00000318352
MRPLDIVELAEPEEVEVLEPEEDFEQFLLPVINEMREDIASLTREHGRAYLRNRSKLWEMDNMLIQIKTQVEASEESALNHLQNPGDAAEGRAAKRCEKAEEKAKEIAKMAEMLVELVRRIEKSESS

SEQ ID NO: 52880 - protein, 127 aa, Homo sapiens; identical to SEQ ID NO: 52879
  Payload ID: 10537
  Gene Symbol: MRFAP1
  Gene Name: Morf4 family associated protein 1
  Uniprot ID: Q9Y605
  ENSP ID: ENSP00000372024

SEQ ID NO: 52881 - protein, 127 aa, Homo sapiens; identical to SEQ ID NO: 52879
  Payload ID: 10537
  Gene Symbol: MRFAP1
  Gene Name: Morf4 family associated protein 1
  Uniprot ID: Q9Y605
  ENSP ID: ENSP00000422065

SEQ ID NO: 52882 - protein, 103 aa, Homo sapiens
  Payload ID: 10537
  Gene Symbol: MRFAP1
  Gene Name: Morf4 family associated protein 1
  ENSP ID: ENSP00000478229
MRPLDIVELAEPEEVEVLEPEEDFEQFLLPVINEMREDIASLTREHGRAYLRNRSKLWEMDNMLIQIKTQVEASEESALNHLQNPGDAAEGRAAKRCEKSESS

SEQ ID NO: 52883 - protein, 127 aa, Homo sapiens
  Payload ID: 10538
  Gene Symbol: MRFAP1L1
  Gene Name: Morf4 family associated protein 1-like 1
  Uniprot ID: Q96HT8
  ENSP ID: ENSP00000318154
MRPLDIDEVEAPEEVEVLEPEEDFEQFLLPVINEMREDIASLIREHGRAYLRTRSKLWEMDNMLIQIKTQVEASEESALNHVQHPSGEADERVSELCEKAEEKAKEIAKMAEMLVELVWRIERSESS

SEQ ID NO: 52884 - protein, 156 aa, Homo sapiens
  Payload ID: 10539
  Gene Symbol: MORN1
  Gene Name: MORN repeat containing 1
  ENSP ID: ENSP00000367786
MAAAGEGTPSSRGPRRDPPRRPPRNGHGKLLFKDGSYYEGAFVDGEITGEGRRHWAWSGDTFSGQFVLGEPQGYGVMEYKAGGCYEGEVSHGMREGHGFLVDRDGQVYQGSFHDNKRHGPGQMLFQNGDKYDGDWVRDRRQGHGVLRCADGSTYKL

SEQ ID NO: 52885 - protein, 350 aa, Homo sapiens
  Payload ID: 10539
  Gene Symbol: MORN1
  Gene Name: MORN repeat containing 1
  Uniprot ID: Q5T089
  ENSP ID: ENSP00000367790
MAAAGEGTPSSRGPRRDPPRRPPRNGYGVYVYPNSFFRYEGEWKAGRKHGHGKLLFKDGSYYEGAFVDGEITGEGRRHWAWSGDTFSGQFVLGEPQGYGVMEYKAGGCYEGEVSHGMREGHGFLVDRDGQVYQGSFHDNKRHGPGQMLFQNGDKYDGDWVRDRRQGHGVLRCADGSTYKGQWHSDVFSGLGSMAHCSGVTYYGLWINGHPAEQATRIVILGPEVMEVAQGSPFSVNVQLLQDHGEIAKSESGRVLQISAGVRYVQLSAYSEVNFFKVDRDNQETLIQTPFGFECIPYPVSSPAAGVPGPRAAKGGAEADVPLPRGDLELHLGALHGQEDTPGGLLGSSLF

SEQ ID NO: 52886 - protein, 497 aa, Homo sapiens
  Payload ID: 10539
  Gene Symbol: MORN1
  Gene Name: MORN repeat containing 1
  Uniprot ID: Q5T089
  ENSP ID: ENSP00000367792
MAAAGEGTPSSRGPRRDPPRRPPRNGYGVYVYPNSFFRYEGEWKAGRKHGHGKLLFKDGSYYEGAFVDGEITGEGRRHWAWSGDTFSGQFVLGEPQGYGVMEYKAGGCYEGEVSHGMREGHGFLVDRDGQVYQGSFHDNKRHGPGQMLFQNGDKYDGDWVRDRRQGHGVLRCADGSTYKGQWHSDVFSGLGSMAHCSGVTYYGLWINGHPAEQATRIVILGPEVMEVAQGSPFSVNVQLLQDHGEIAKSESGRVLQISAGVRYVQLSAYSEVNFFKVDRDNQETLIQTPFGFECIPYPVSSPAAGVPGPRAAKGGAEADVPLPRGDLELHLGALHGQEDTPGGLLARGHAPHCPGACQRVEQGCAEFTDVLLGPPPPGYHPFLFLDSLHKKAGGRSRGGLHPRGTPPTAQEPPGGSRPEGRATEEQAAAAHLGEYVLMIRDVTTPPFLGRRLPPAFKHLRVVAKRAGQPPHVLEEGPEASSSWQAAHSCTPEPPAPR

SEQ ID NO: 52887 - protein, 185 aa, Homo sapiens
  Payload ID: 10539
  Gene Symbol: MORN1
  Gene Name: MORN repeat containing 1
  ENSP ID: ENSP00000390261
VTGSCYLKMAVITKGRLWTERSREKAAGTGPGQETPSLDSLFWESLKATASWSTKPADVMKGRSPTACGKDTGFWWTGMDKCTRAPSMTTRGTALGRCSFRTVTSTTATGSGTGVRDTGCCAAPTAPPTSSDPPIYSRRNSRRHRLLPRHHELRVGEAPPGDLFSLSTAGVFSANRVSCLAASIP

SEQ ID NO: 52888 - protein, 60 aa, Homo sapiens
  Payload ID: 10539
  Gene Symbol: MORN1
  Gene Name: MORN repeat containing 1
  ENSP ID: ENSP00000476189
  MOD_RES (1)..(1): Any amino acid
XYGVYVYPNSFFRYEGEWKAGRKHGHGKLLFKDGSYYEGAFVDGEITGEGRRHWAWSGEL

SEQ ID NO: 52889 - protein, 79 aa, Homo sapiens
  Payload ID: 10540
  Gene Symbol: MORN2
  Gene Name: MORN repeat containing 2
  Uniprot ID: Q502X0
  ENSP ID: ENSP00000344551
MNGFGRLEHFSGAVYEGQFKDNMFHGLGTYTFPNGAKYTGNFNENRVEGEGEYTDIQGLEWSGNFHFTAAPDLKLKLHM

SEQ ID NO: 52890 - protein, 79 aa, Homo sapiens; identical to SEQ ID NO: 52889
  Payload ID: 10540
  Gene Symbol: MORN2
  Gene Name: MORN repeat containing 2
  Uniprot ID: Q502X0
  ENSP ID: ENSP00000386563

SEQ ID NO: 52891 - protein, 79 aa, Homo sapiens; identical to SEQ ID NO: 52889
  Payload ID: 10540
  Gene Symbol: MORN2
  Gene Name: MORN repeat containing 2
  Uniprot ID: Q502X0
  ENSP ID: ENSP00000386874

SEQ ID NO: 52892 - protein, 46 aa, Homo sapiens
  Payload ID: 10540
  Gene Symbol: MORN2
  Gene Name: MORN repeat containing 2
  ENSP ID: ENSP00000387161
MGLSTQEAGKMTRVEGEGEYTDIQGLEWSGNFHFTAAPDLKLKLHM

SEQ ID NO: 52893 - protein, 57 aa, Homo sapiens
  Payload ID: 10540
  Gene Symbol: MORN2
  Gene Name: MORN repeat containing 2
  ENSP ID: ENSP00000387181
MFHGLGTYTFPNGAKYTGNFNENRVEGEGEYTDIQGLEWSGNFHFTAAPDLKLKLHM

SEQ ID NO: 52894 - protein, 68 aa, Homo sapiens
  Payload ID: 10540
  Gene Symbol: MORN2
  Gene Name: MORN repeat containing 2
  ENSP ID: ENSP00000401340
MNGFGRLEHFSGAVYEGQFKDNMFHGLGTYTFPNGAKYTGNFNENRGSQASLLLLFITFKLIQNPDKP

SEQ ID NO: 52895 - protein, 240 aa, Homo sapiens
  Payload ID: 10541
  Gene Symbol: MORN3
  Gene Name: MORN repeat containing 3
  Uniprot ID: Q6PF18
  ENSP ID: ENSP00000347486
MPVSKCPKKSESLWKGWDRKAQRNGLRSQVYAVNGDYYVGEWKDNVKHGKGTQVWKKKGAIYEGDWKFGKRDGYGTLSLPDQQTGKCRRVYSGWWKGDKKSGYGIQFFGPKEYYEGDWCGSQRSGWGRMYYSNGDIYEGQWENDKPNGEGMLRLKNGNRYEGCWERGMKNGAGRFFHLDHGQLFEGFWVDNMAKCGTMIDFGRDEAPEPTQFPIPEVKILDPDGVLAEALAMFRKTEEGD

SEQ ID NO: 52896 - protein, 160 aa, Homo sapiens
  Payload ID: 10541
  Gene Symbol: MORN3
  Gene Name: MORN repeat containing 3
  Uniprot ID: Q6PF18
  ENSP ID: ENSP00000376255
MPVSKCPKKSESLWKGWDRKAQRNGLRSQVYAVNGDYYVGEWKDNVKHGKGTQVWKKKGAIYEGDWKFGKRDGYGTLSLPDQQTGKCRRVYSGWWKGDKKSGYGIQFFGPKEYYEGDWCGSQRSGWGRMYYSNGDIYEGQWENDKPNGEGMLRLSQNPRP

SEQ ID NO: 52897 - protein, 160 aa, Homo sapiens; identical to SEQ ID NO: 52896
  Payload ID: 10541
  Gene Symbol: MORN3
  Gene Name: MORN repeat containing 3
  Uniprot ID: Q6PF18
  ENSP ID: ENSP00000445643

SEQ ID NO: 52898 - protein, 146 aa, Homo sapiens
  Payload ID: 10542
  Gene Symbol: MORN4
  Gene Name: MORN repeat containing 4
  Uniprot ID: Q8NDC4
  ENSP ID: ENSP00000307636
MTLTKGSFTYSSGEEYRGEWKEGRRHGFGQLMFADGGTYLGHFENGLFNGFGVLTFSDGSRYEGEFAQGKFNGVGVFIRYDNMTFEGEFKNGRVDGFGLLTFPDGSHGIPRNEGLFENNKLLRREKCSAIVQRAQSASKSARNLTA

SEQ ID NO: 52899 - protein, 46 aa, Homo sapiens
  Payload ID: 10542
  Gene Symbol: MORN4
  Gene Name: MORN repeat containing 4
  ENSP ID: ENSP00000359669
MTLTKGSFTYSSGEEYRGEWKEGEKDPWGVSMMNTSFAGGQIHQDI

SEQ ID NO: 52900 - protein, 66 aa, Homo sapiens
  Payload ID: 10542
  Gene Symbol: MORN4
  Gene Name: MORN repeat containing 4
  ENSP ID: ENSP00000441070
MTLTKGSFTYSSGEEYRGEWKEGRRHGFGQLMFADGGTYLGHFENGLFNGFGVLTFSDGSRPADFP

SEQ ID NO: 52901 - protein, 161 aa, Homo sapiens
  Payload ID: 10543
  Gene Symbol: MORN5
  Gene Name: MORN repeat containing 5
  Uniprot ID: Q5VZ52
  ENSP ID: ENSP00000362869
MEYTGSKYIGEYVDGRMEGKAKYILPTETIYVGEMKDGMFHGEGTLYFPSGSQYDAIWENGLAIKGTYTFSDGLHYDEKNWHYCDGYDRRFYTEILNGLKPAGMAQLTNMDPPRKIPKGYYDCGDGFYNPVTRVVKDYRNRFLRNADDDEHEWITRTCRKG

SEQ ID NO: 52902 - protein, 110 aa, Homo sapiens
  Payload ID: 10543
  Gene Symbol: MORN5
  Gene Name: MORN repeat containing 5
  ENSP ID: ENSP00000409949
MEGKAKYILPTETIYVGEMKDGMFHGEGTLYFPSGSQYDAIWENGLAIKGTYTFSDGLHYDEKNWHYCDGYDRRFYTEILNGLKPAGMAQLTNMDPPRKIPKGYYDCGDG

SEQ ID NO: 52903 - protein, 96 aa, Homo sapiens
  Payload ID: 10543
  Gene Symbol: MORN5
  Gene Name: MORN repeat containing 5
  ENSP ID: ENSP00000437483
MEYTGSKYIGEYVDGRMEGKAKYILPTETIYVGEMKDGMFHGEGTLYFPSGSQYDAIWENGLAIKVWLNSPIWTHLEKSPRAITIVETASITQSRG

SEQ ID NO: 52904 - protein, 362 aa, Homo sapiens
  Payload ID: 10544
  Gene Symbol: MORF4L1
  Gene Name: mortality factor 4 like 1
  Uniprot ID: Q9UBU8
  ENSP ID: ENSP00000331310
MAPKQDPKPKFQEGERVLCFHGPLLYEAKCVKVAIKDKQVKYFIHYSGWNKKSAVRPRRSEKSLKTHEDIVALFPVPEGAPSVHHPLLTSSWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 52905 - protein, 348 aa, Homo sapiens
  Payload ID: 10544
  Gene Symbol: MORF4L1
  Gene Name: mortality factor 4 like 1
  ENSP ID: ENSP00000368850
MIPFPHPQVTDALGRYSNYILSSTVESPSLRSMNFEKQGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 52906 - protein, 323 aa, Homo sapiens
  Payload ID: 10544
  Gene Symbol: MORF4L1
  Gene Name: mortality factor 4 like 1
  Uniprot ID: Q9UBU8
  ENSP ID: ENSP00000408880
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 52907 - protein, 235 aa, Homo sapiens
  Payload ID: 10544
  Gene Symbol: MORF4L1
  Gene Name: mortality factor 4 like 1
  Uniprot ID: Q9UBU8
  ENSP ID: ENSP00000452717
MRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 52908 - protein, 235 aa, Homo sapiens; identical to SEQ ID NO: 52907
  Payload ID: 10544
  Gene Symbol: MORF4L1
  Gene Name: mortality factor 4 like 1
  Uniprot ID: Q9UBU8
  ENSP ID: ENSP00000452808

SEQ ID NO: 52909 - protein, 269 aa, Homo sapiens
  Payload ID: 10544
  Gene Symbol: MORF4L1
  Gene Name: mortality factor 4 like 1
  ENSP ID: ENSP00000453231
MAPKQDPKPKFQEGERVLCFHGPLLYEAKCVKVAIKDKQVKYFIHYSGWNKNWDEWVPESRVLKYVDTNLQKQRELQKANQKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLK

SEQ ID NO: 52910 - protein, 113 aa, Homo sapiens
  Payload ID: 10544
  Gene Symbol: MORF4L1
  Gene Name: mortality factor 4 like 1
  ENSP ID: ENSP00000453351
MRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYK

SEQ ID NO: 52911 - protein, 156 aa, Homo sapiens
  Payload ID: 10544
  Gene Symbol: MORF4L1
  Gene Name: mortality factor 4 like 1
  ENSP ID: ENSP00000453432
MRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAE

SEQ ID NO: 52912 - protein, 245 aa, Homo sapiens
  Payload ID: 10544
  Gene Symbol: MORF4L1
  Gene Name: mortality factor 4 like 1
  ENSP ID: ENSP00000453625
MEVTGPRFQCTFFSGSSSQGEKNGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLY

SEQ ID NO: 52913 - protein, 118 aa, Homo sapiens
  Payload ID: 10544
  Gene Symbol: MORF4L1
  Gene Name: mortality factor 4 like 1
  ENSP ID: ENSP00000453738
MRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGN

SEQ ID NO: 52914 - protein, 213 aa, Homo sapiens
  Payload ID: 10544
  Gene Symbol: MORF4L1
  Gene Name: mortality factor 4 like 1
  ENSP ID: ENSP00000453972
  MOD_RES (1)..(1): Any amino acid
XLLYEAKCVKVAIKDKQVKYFIHYSGWNKNAVRPRRSEKSLKTHEDIVALFPVPEGAPSVHHPLLTSSWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDY

SEQ ID NO: 52915 - protein, 58 aa, Homo sapiens
  Payload ID: 10544
  Gene Symbol: MORF4L1
  Gene Name: mortality factor 4 like 1
  ENSP ID: ENSP00000454030
MRGAAPGKKTSGLQQKNVEVKTKKNKQKTPGNGDGGSTSETPQPPRKKRARVDPTVEN

SEQ ID NO: 52916 - protein, 74 aa, Homo sapiens
  Payload ID: 10544
  Gene Symbol: MORF4L1
  Gene Name: mortality factor 4 like 1
  ENSP ID: ENSP00000454191
MRGAAPGKKTSGLQQKNVEVKTKKNKQKTPGNGDGGSTSETPQPPRKKRARVDPTVENEETFMNRVEVKVKIPE

SEQ ID NO: 52917 - protein, 288 aa, Homo sapiens
  Payload ID: 10545
  Gene Symbol: MORF4L2
  Gene Name: mortality factor 4 like 2
  Uniprot ID: Q15014
  ENSP ID: ENSP00000353643
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEYAVNEVVAGIKEYFNVMLGTQLLYKFERPQYAEILLAHPDAPMSQVYGAPHLLRLFVRIGAMLAYTPLDEKSLALLLGYLHDFLKYLAKNSASLFTASDYKVASAEYHRKAL

SEQ ID NO: 52918 - protein, 288 aa, Homo sapiens; identical to SEQ ID NO: 52917
  Payload ID: 10545
  Gene Symbol: MORF4L2
  Gene Name: mortality factor 4 like 2
  Uniprot ID: Q15014
  ENSP ID: ENSP00000391969

SEQ ID NO: 52919 - protein, 177 aa, Homo sapiens
  Payload ID: 10545
  Gene Symbol: MORF4L2
  Gene Name: mortality factor 4 like 2
  ENSP ID: ENSP00000393283
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEY

SEQ ID NO: 52920 - protein, 288 aa, Homo sapiens; identical to SEQ ID NO: 52917
  Payload ID: 10545
  Gene Symbol: MORF4L2
  Gene Name: mortality factor 4 like 2
  Uniprot ID: Q15014
  ENSP ID: ENSP00000394417

SEQ ID NO: 52921 - protein, 158 aa, Homo sapiens
  Payload ID: 10545
  Gene Symbol: MORF4L2
  Gene Name: mortality factor 4 like 2
  ENSP ID: ENSP00000400938
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAI

SEQ ID NO: 52922 - protein, 67 aa, Homo sapiens
  Payload ID: 10545
  Gene Symbol: MORF4L2
  Gene Name: mortality factor 4 like 2
  ENSP ID: ENSP00000408607
MSSRKQGSQPRGQQSAEEENFKKPTRSNMQRSKMRGASSGKKTAGPQQKNLEPALPGRWGGRSAENP

SEQ ID NO: 52923 - protein, 288 aa, Homo sapiens; identical to SEQ ID NO: 52917
  Payload ID: 10545
  Gene Symbol: MORF4L2
  Gene Name: mortality factor 4 like 2
  Uniprot ID: Q15014
  ENSP ID: ENSP00000410532

SEQ ID NO: 52924 - protein, 177 aa, Homo sapiens; identical to SEQ ID NO: 52919
  Payload ID: 10545
  Gene Symbol: MORF4L2
  Gene Name: mortality factor 4 like 2
  ENSP ID: ENSP00000413664

SEQ ID NO: 52925 - protein, 288 aa, Homo sapiens; identical to SEQ ID NO: 52917
  Payload ID: 10545
  Gene Symbol: MORF4L2
  Gene Name: mortality factor 4 like 2
  Uniprot ID: Q15014
  ENSP ID: ENSP00000415476

SEQ ID NO: 52926 - protein, 237 aa, Homo sapiens
  Payload ID: 10545
  Gene Symbol: MORF4L2
  Gene Name: mortality factor 4 like 2
  ENSP ID: ENSP00000416120
MRGASSGKKTAGPQQKNLESVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEYAVNEVVAGIKEYFNVMLGTQLLYKFERPQYAEILLAHPDAPMSQVYGAPHLLRLFVRIGAMLAYTPLDEKSLALLLGYLHDFLKYLAKNSASLFTASDYKVASAEYHRKAL

SEQ ID NO: 52927 - protein, 214 aa, Homo sapiens
  Payload ID: 10546
  Gene Symbol: MOSPD1
  Gene Name: motile sperm domain containing 1
  Uniprot ID: Q9UJG1
  ENSP ID: ENSP00000359813
MHQQKRQPELVEGNLPVFVFPTELIFYADDQSTHKQVLTLYNPYEFALKFKVLCTTPNKYVVVDAAGAVKPQCCVDIVIRHRDVRSCHYGVIDKFRLQVSEQSQRKALGRKEVVATLLPSAKEQQKEEEEKRLKEHLTESLFFEQSFQPGKNRAVSSGPSLLTVFLGVVCIAALMLPTLGDVESLVPLYLHLSVNQKLVAAYILGLITMAILRT

SEQ ID NO: 52928 - protein, 159 aa, Homo sapiens
  Payload ID: 10546
  Gene Symbol: MOSPD1
  Gene Name: motile sperm domain containing 1
  Uniprot ID: Q9UJG1
  ENSP ID: ENSP00000359815
MHQQKRQPELVEGNLPVFVFPTELIFYADDQSTHKQVLTLYNPYEFALKFKVLCTTPNKYVVVDAAGAVKPQCCVDIVIRHRDVRSCHYGVIDKFRLQVSEQSQRKALGRKEVVATLLPSAKEQQKEEEEKRLKEHLTESLFFEQSFQPGLITMAILRT

SEQ ID NO: 52929 - protein, 213 aa, Homo sapiens
  Payload ID: 10546
  Gene Symbol: MOSPD1
  Gene Name: motile sperm domain containing 1
  Uniprot ID: Q9UJG1
  ENSP ID: ENSP00000359819
MHQQKRQPELVEGNLPVFVFPTELIFYADDQSTHKQVLTLYNPYEFALKFKVLCTTPNKYVVVDAAGAVKPQCCVDIVIRHRDVRSCHYGVIDKFRLQVSEQSQRKALGRKEVVATLLPSAKEQQKEEEEKRLKEHLTESLFFEQSFQPENRAVSSGPSLLTVFLGVVCIAALMLPTLGDVESLVPLYLHLSVNQKLVAAYILGLITMAILRT

SEQ ID NO: 52930 - protein, 518 aa, Homo sapiens
  Payload ID: 10547
  Gene Symbol: MOSPD2
  Gene Name: motile sperm domain containing 2
  Uniprot ID: Q8NHP6
  ENSP ID: ENSP00000369860
MAENHAQNKAKLISETRRRFEAEYVTDKSDKYDARDVERLQQDDNWVESYLSWRHNIVDETLKMLDESFQWRKEISVNDLNESSIPRWLLEIGVIYLHGYDKEGNKLFWIRVKYHVKDQKTILDKKKLIAFWLERYAKRENGKPVTVMFDLSETGINSIDMDFVRFIINCFKVYYPKYLSKIVIFDMPWLMNAAFKIVKTWLGPEAVSLLKFTSKNEVQDYVSVEYLPPHMGGTDPFKYSYPPLVDDDFQTPLCENGPITSEDETSSKEDIESDGKETLETISNEEQTPLLKKINPTESTSKAEENEKVDSKVKAFKKPLSVFKGPLLHISPAEELYFGSTESGEKKTLIVLTNVTKNIVAFKVRTTAPEKYRVKPSNSSCDPGASVDIVVSPHGGLTVSAQDRFLIMAAEMEQSSGTGPAELTQFWKEVPRNKVMEHRLRCHTVESSKPNTLTLKDNAFNMSDKTSEDICLQLSRLLESNRKLEDQVQRCIWFQQLLLSLTMLLLAFVTSFFYLLYS

SEQ ID NO: 52931 - protein, 486 aa, Homo sapiens
  Payload ID: 10547
  Gene Symbol: MOSPD2
  Gene Name: motile sperm domain containing 2
  ENSP ID: ENSP00000473271
MAENHAQNKAKLISETRRRFEAEYVTDKSDKYDARDVERLQQDDNWVESYLSWRHNIVDETLKMLDESFQWRKEISVNDLNESSIPRWLLEIGVIYLHGYDKEGNKLFWIRVKYHVKDQKTILDKKKLIAFWLERYAKRENGKPVTVMFDLSETGINSIDMDFVRFIINCFKVYYPKYLSKIVIFDMPWLMNAAFKIVKTWLGPEAVSLLKFTSKNEVQDYVSVEYLPPHMGGTDPFKYSYPPLVDDDFQTPLCENGPITSEDETSSKEDIESDGKETLETISNEEQTPLLKKINPTESTSKAEENEKVDSKVKAFKKPLSVFKGPLLHISPAEELYFGSTESGEKKTLIVLTNVTKNIVAFKVRTTAPEKYRVKPSNSSCDPGASVDIVVSPHGGLTVSAQDRFLIMAAEMEQSSGTGPAELTQFWKEVPRNKVMEHRLRCHTVESSKPNTLTLKDNAFNMSDKTSEDICLQFATSSCEMDCSPP

SEQ ID NO: 52932 - protein, 157 aa, Homo sapiens
  Payload ID: 10547
  Gene Symbol: MOSPD2
  Gene Name: motile sperm domain containing 2
  ENSP ID: ENSP00000473379
SKNEVQDYVSVEYLPPHMGGTDPFKYSYPPLVDDDFQTPLCENGPITSEDETSSKEDIESDGKETLETISNEEQTPLLKKINPTESTSKAEENEKVDSKVKAFKKPLSVFKGPLLHISPAEELYFGSTESGEKKTLIVLTNVTKNIVAFKGDIPNAK

SEQ ID NO: 52933 - protein, 39 aa, Homo sapiens
  Payload ID: 10547
  Gene Symbol: MOSPD2
  Gene Name: motile sperm domain containing 2
  ENSP ID: ENSP00000473570
MAENHAQNKAKLISETRRRFEAEYVTGGYSVPGIKKGVQ

SEQ ID NO: 52934 - protein, 235 aa, Homo sapiens
  Payload ID: 10548
  Gene Symbol: MOSPD3
  Gene Name: motile sperm domain containing 3
  Uniprot ID: O75425
  ENSP ID: ENSP00000223054
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIVIRHVAPIPSHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLGLLTMVFLRT

SEQ ID NO: 52935 - protein, 235 aa, Homo sapiens; identical to SEQ ID NO: 52934
  Payload ID: 10548
  Gene Symbol: MOSPD3
  Gene Name: motile sperm domain containing 3
  Uniprot ID: O75425
  ENSP ID: ENSP00000368842

SEQ ID NO: 52936 - protein, 235 aa, Homo sapiens; identical to SEQ ID NO: 52934
  Payload ID: 10548
  Gene Symbol: MOSPD3
  Gene Name: motile sperm domain containing 3
  Uniprot ID: O75425
  ENSP ID: ENSP00000377522

SEQ ID NO: 52937 - protein, 225 aa, Homo sapiens
  Payload ID: 10548
  Gene Symbol: MOSPD3
  Gene Name: motile sperm domain containing 3
  Uniprot ID: O75425
  ENSP ID: ENSP00000404626
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLGLLTMVFLRT

SEQ ID NO: 52938 - protein, 225 aa, Homo sapiens
  Payload ID: 10548
  Gene Symbol: MOSPD3
  Gene Name: motile sperm domain containing 3
  ENSP ID: ENSP00000417276
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIVIRHVAPIPSHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVL

SEQ ID NO: 52939 - protein, 69 aa, Homo sapiens
  Payload ID: 10548
  Gene Symbol: MOSPD3
  Gene Name: motile sperm domain containing 3
  ENSP ID: ENSP00000419535
MRRGAPQDQELVGPGPPGRGSRGAPPPLGPVVPVLVFPPDLVFRADQRSGPRQLLTLYNPTGTALRFRV

SEQ ID NO: 52940 - protein, 114 aa, Homo sapiens
  Payload ID: 10549
  Gene Symbol: MLN
  Gene Name: motilin
  Uniprot ID: P12872
  ENSP ID: ENSP00000266003
MVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLSEMLPQHAK

SEQ ID NO: 52941 - protein, 115 aa, Homo sapiens
  Payload ID: 10549
  Gene Symbol: MLN
  Gene Name: motilin
  Uniprot ID: P12872
  ENSP ID: ENSP00000388825
MVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLSEMLPQHAAK

SEQ ID NO: 52942 - protein, 108 aa, Homo sapiens
  Payload ID: 10549
  Gene Symbol: MLN
  Gene Name: motilin
  Uniprot ID: P12872
  ENSP ID: ENSP00000425467
MVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLTAK

SEQ ID NO: 52943 - protein, 412 aa, Homo sapiens
  Payload ID: 10550
  Gene Symbol: MLNR
  Gene Name: motilin receptor
  Uniprot ID: O43193
  ENSP ID: ENSP00000218721
MGSPWNGSDGPEGAREPPWPALPPCDERRCSPFPLGALVPVTAVCLCLFVVGVSGNVVTVMLIGRYRDMRTTTNLYLGSMAVSDLLILLGLPFDLYRLWRSRPWVFGPLLCRLSLYVGEGCTYATLLHMTALSVERYLAICRPLRARVLVTRRRVRALIAVLWAVALLSAGPFLFLVGVEQDPGISVVPGLNGTARIASSPLASSPPLWLSRAPPPSPPSGPETAEAAALFSRECRPSPAQLGALRVMLWVTTAYFFLPFLCLSILYGLIGRELWSSRRPLRGPAASGRERGHRQTVRVLLVVVLAFIICWLPFHVGRIIYINTEDSRMMYFSQYFNIVALQLFYLSASINPILYNLISKKYRAAAFKLLLARKSRPRGFHRSRDTAGEVAGDTGGDTVGYTETSANVKTMG

SEQ ID NO: 52944 - protein, 401 aa, Homo sapiens
  Payload ID: 10551
  Gene Symbol: MNX1
  Gene Name: motor neuron and pancreas homeobox 1
  Uniprot ID: P50219
  ENSP ID: ENSP00000252971
MEKSKNFRIDALLAVDPPRAASAQSAPLALVTSLAAAASGTGGGGGGGGASGGTSGSCSPASSEPPAAPADRLRAESPSPPRLLAAHCALLPKPGFLGAGGGGGGTGGGHGGPHHHAHPGAAAAAAAAAAAAAAGGLALGLHPGGAQGGAGLPAQAALYGHPVYGYSAAAAAAALAGQHPALSYSYPQVQGAHPAHPADPIKLGAGTFQLDQWLRASTAGMILPKMPDFNSQAQSNLLGKCRRPRTAFTSQQLLELEHQFKLNKYLSRPKRFEVATSLMLTETQVKIWFQNRRMKWKRSKKAKEQAAQEAEKQKGGGGGAGKGGAEEPGAEELLGPPAPGDKGSGRRLRDLRDSDPEEDEDEDDEDHFPYSNGASVHAASSDCSSEDDSPPPRPSHQPAPQ

SEQ ID NO: 52945 - protein, 82 aa, Homo sapiens
  Payload ID: 10551
  Gene Symbol: MNX1
  Gene Name: motor neuron and pancreas homeobox 1
  ENSP ID: ENSP00000401158
MGGLSTVGACPGILGAQQAQAQSNLLGKCRRPRTAFTSQQLLELEHQFKLNKYLSRPKRFEVATSLMLTETQVKIWFQNRRM

SEQ ID NO: 52946 - protein, 29 aa, Homo sapiens
  Payload ID: 10551
  Gene Symbol: MNX1
  Gene Name: motor neuron and pancreas homeobox 1
  ENSP ID: ENSP00000416458
MGGLSTVGACPGILGAQQGEDLVPEPADE

SEQ ID NO: 52947 - protein, 189 aa, Homo sapiens
  Payload ID: 10551
  Gene Symbol: MNX1
  Gene Name: motor neuron and pancreas homeobox 1
  Uniprot ID: P50219
  ENSP ID: ENSP00000438552
MGGLSTVGACPGILGAQQAQAQSNLLGKCRRPRTAFTSQQLLELEHQFKLNKYLSRPKRFEVATSLMLTETQVKIWFQNRRMKWKRSKKAKEQAAQEAEKQKGGGGGAGKGGAEEPGAEELLGPPAPGDKGSGRRLRDLRDSDPEEDEDEDDEDHFPYSNGASVHAASSDCSSEDDSPPPRPSHQPAPQ

SEQ ID NO: 52948 - protein, 143 aa, Homo sapiens
  Payload ID: 10551
  Gene Symbol: MNX1
  Gene Name: motor neuron and pancreas homeobox 1
  ENSP ID: ENSP00000473965
MGGLSTVGACPGILGAQQGNECPSKVGPREPLFSPPQSRWASGSFLSIRAGHLARGLGPSGFPGTRGLSGLGLRGSGSLGLWLSPLAPSGSATYESGRADVYGSTLSAAEHPNKETPLFLSEWICLDWGDAGRAGEKQKRKQK

SEQ ID NO: 52949 - protein, 31 aa, Homo sapiens
  Payload ID: 10551
  Gene Symbol: MNX1
  Gene Name: motor neuron and pancreas homeobox 1
  ENSP ID: ENSP00000474286
  MOD_RES (1)..(1): Any amino acid
XAGMILPKMPDFNCKEGTDTLTSCTLGSFQN

SEQ ID NO: 52950 - protein, 36 aa, Homo sapiens
  Payload ID: 10551
  Gene Symbol: MNX1
  Gene Name: motor neuron and pancreas homeobox 1
  ENSP ID: ENSP00000475129
MGGLSTVGACPGILGAQQGKEGTDTLTSCTLGSFQN

SEQ ID NO: 52951 - protein, 1003 aa, Homo sapiens
  Payload ID: 10552
  Gene Symbol: MOV10
  Gene Name: Mov10 RISC complex RNA helicase
  Uniprot ID: Q9HCE1
  ENSP ID: ENSP00000350028
MPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 52952 - protein, 947 aa, Homo sapiens
  Payload ID: 10552
  Gene Symbol: MOV10
  Gene Name: Mov10 RISC complex RNA helicase
  ENSP ID: ENSP00000358658
MLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 52953 - protein, 1003 aa, Homo sapiens; identical to SEQ ID NO: 52951
  Payload ID: 10552
  Gene Symbol: MOV10
  Gene Name: Mov10 RISC complex RNA helicase
  Uniprot ID: Q9HCE1
  ENSP ID: ENSP00000358659

SEQ ID NO: 52954 - protein, 1003 aa, Homo sapiens; identical to SEQ ID NO: 52951
  Payload ID: 10552
  Gene Symbol: MOV10
  Gene Name: Mov10 RISC complex RNA helicase
  Uniprot ID: Q9HCE1
  ENSP ID: ENSP00000399797

SEQ ID NO: 52955 - protein, 1211 aa, Homo sapiens
  Payload ID: 10553
  Gene Symbol: MOV10L1
  Gene Name: Mov10 RISC complex RNA helicase like 1
  Uniprot ID: Q9BXT6
  ENSP ID: ENSP00000262794
MLSLAAKLVAFFWRTADTPREEAGQLEPELAEGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVCISSLCGRNGVLEESIFFTLDSLKLPDGYTPRRGDVVNAVVVESSQSCYVWRALCMTLVKRRDAAPVHEATHFYGTILLKNKGDIEVTQVTHFGTLKEGRSKTMVIWIENKGDIPQNLVSCKLAGWDKSKQFRFQMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKRNSRRQLPSFLPQYPIPDRLRKCVEQKIDILTFQPLLAELLNMSNYKEKFSTLLWLEEIYAEMELKEYNMSGIILRRNGDLLVLEVPGLAEGRPSLYAGDKLILKTQEYNGHAIEYISYVTEIHEEDVTLKINPEFEQAYNFEPMDVEFTYNRTTSRRCHFALEHVIHLGVKVLFPEEIILQSPQVTGNWNHAQDTKSSGQSTSKKNRKTMTDQAEHGTEERRVGDKDLPVLAPFTAEMSDWVDEIQTPKARKMEFFNPVLNENQKLAVKRILSGDCRPLPYILFGPPGTGKTVTIIEAVLQVHFALPDSRILVCAPSNSAADLVCLRLHESKVLQPATMVRVNATCRFEEIVIDAVKPYCRDGEDIWKASRFRIIITTCSSSGLFYQIGVRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRDPCFGALLEYSITNGVYMGCDLPPALQSLQNCGEGVADPSYPVVPESTGPEKHQEPS

SEQ ID NO: 52956 - protein, 125 aa, Homo sapiens
  Payload ID: 10553
  Gene Symbol: MOV10L1
  Gene Name: Mov10 RISC complex RNA helicase like 1
  Uniprot ID: Q9BXT6
  ENSP ID: ENSP00000346917
MSDISGQVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVRPAQARLVL

SEQ ID NO: 52957 - protein, 338 aa, Homo sapiens
  Payload ID: 10553
  Gene Symbol: MOV10L1
  Gene Name: Mov10 RISC complex RNA helicase like 1
  Uniprot ID: Q9BXT6
  ENSP ID: ENSP00000379193
MFRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRDPCFGALLEYSITNGVYMGCDLPPALQSLQNCGEGVADPSYPVVPESTGPEKHQEPS

SEQ ID NO: 52958 - protein, 56 aa, Homo sapiens
  Payload ID: 10553
  Gene Symbol: MOV10L1
  Gene Name: Mov10 RISC complex RNA helicase like 1
  ENSP ID: ENSP00000379195
MLSLAAKLVAFFWRTADTPREEAGQLEPELAEGGSREAAGRRVPGPRVSATREPRP

SEQ ID NO: 52959 - protein, 1165 aa, Homo sapiens
  Payload ID: 10553
  Gene Symbol: MOV10L1
  Gene Name: Mov10 RISC complex RNA helicase like 1
  Uniprot ID: Q9BXT6
  ENSP ID: ENSP00000379199
MLSLAAKLVAFFWRTADTPREEAGQLEPELAEGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVCISSLCGRNGVLEESIFFTLDSLKLPDGYTPRRGDVVNAVVVESSQSCYVWRALCMTLVKRRDAAPVHEATHFYGTILLKNKGDIEVTQVTHFGTLKEGRSKTMVIWIENKGDIPQNLVSCKLAGWDKSKQFRFQMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKRNSRRQLPSFLPQYPIPDRLRKCVEQKIDILTFQPLLAELLNMSNYKEKFSTLLWLEEIYAEMELKEYNMSGIILRRNGDLLVLEVPGLAEGRPSLYAGDKLILKTQEYNGHAIEYISYVTEIHEEDVTLKINPEFEQAYNFEPMDVEFTYNRTTSRRCHFALEHVIHLGVKVLFPEEIILQSPQVTGNWNHAQDTKSSGQSTSKKNRKTMTDQAEHGTEERRVGDKDLPVLAPFTAEMSDWVDEIQTPKARKMEFFNPVLNENQKLAVKRILSGDCRPLPYILFGPPGTGKTVTIIEAVLQVHFALPDSRILVCAPSNSAADLVCLRLHESKVLQPATMVRVNATCRFEEIVIDAVKPYCRDGEDIWKASRFRIIITTCSSSGLFYQIGVRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTDPCFGALLEYSITNGVYMGCDLPPALQSLQNCGEGVADPSYPVVPESTGPEKHQEPS

SEQ ID NO: 52960 - protein, 166 aa, Homo sapiens
  Payload ID: 10553
  Gene Symbol: MOV10L1
  Gene Name: Mov10 RISC complex RNA helicase like 1
  ENSP ID: ENSP00000399776
  MOD_RES (1)..(1): Any amino acid
XMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKSF

SEQ ID NO: 52961 - protein, 56 aa, Homo sapiens; identical to SEQ ID NO: 52958
  Payload ID: 10553
  Gene Symbol: MOV10L1
  Gene Name: Mov10 RISC complex RNA helicase like 1
  ENSP ID: ENSP00000410957

SEQ ID NO: 52962 - protein, 1165 aa, Homo sapiens
  Payload ID: 10553
  Gene Symbol: MOV10L1
  Gene Name: Mov10 RISC complex RNA helicase like 1
  Uniprot ID: Q9BXT6
  ENSP ID: ENSP00000438542
MSFLPVRSVIGGGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVCISSLCGRNGVLEESIFFTLDSLKLPDGYTPRRGDVVNAVVVESSQSCYVWRALCMTLVKRRDAAPVHEATHFYGTILLKNKGDIEVTQVTHFGTLKEGRSKTMVIWIENKGDIPQNLVSCKLAGWDKSKQFRFQMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKRNSRRQLPSFLPQYPIPDRLRKCVEQKIDILTFQPLLAELLNMSNYKEKFSTLLWLEEIYAEMELKEYNMSGIILRRNGDLLVLEVPGLAEGRPSLYAGDKLILKTQEYNGHAIEYISYVTEIHEEDVTLKINPEFEQAYNFEPMDVEFTYNRTTSRRCHFALEHVIHLGVKVLFPEEIILQSPQVTGNWNHAQDTKSSGQSTSKKNRKTMTDQAEHGTEERRVGDKDLPVLAPFTAEMSDWVDEIQTPKARKMEFFNPVLNENQKLAVKRILSGDCRPLPYILFGPPGTGKTVTIIEAVLQVHFALPDSRILVCAPSNSAADLVCLRLHESKVLQPATMVRVNATCRFEEIVIDAVKPYCRDGEDIWKASRFRIIITTCSSSGLFYQIGVRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRLWRGGGRPLLPSGARIHRTREASGAQLICSG

SEQ ID NO: 52963 - protein, 1211 aa, Homo sapiens; identical to SEQ ID NO: 52955
  Payload ID: 10553
  Gene Symbol: MOV10L1
  Gene Name: Mov10 RISC complex RNA helicase like 1
  Uniprot ID: Q9BXT6
  ENSP ID: ENSP00000438978

SEQ ID NO: 52964 - protein, 681 aa, Homo sapiens
  Payload ID: 10554
  Gene Symbol: MPHOSPH10
  Gene Name: M-phase phosphoprotein 10 (U3 small nucleolar ribonucleoprotein)
  Uniprot ID: O00566
  ENSP ID: ENSP00000244230
MAPQVWRRRTLERCLTEVGKATGRPECFLTIQEGLASKFTSLTKVLYDFNKILENGRIHGSPLQKLVIENFDDEQIWQQLELQNEPILQYFQNAVSETINDEDISLLPESEEQEREEDGSEIEADDKEDLEDLEEEEVSDMGNDDPEMGERAENSSKSDLRKSPVFSDEDSDLDFDISKLEQQSKVQNKGQGKPREKSIVDDKFFKLSEMEAYLENIEKEEERKDDNDEEEEDIDFFEDIDSDEDEGGLFGSKKLKSGKSSRNLKYKDFFDPVESDEDITNVHDDELDSNKEDDEIAEEEAEELSISETDEDDDLQENEDNKQHKESLKRVTFALPDDAETEDTGVLNVKKNSDEVKSSFEKRQEKMNEKIASLEKELLEKKPWQLQGEVTAQKRPENSLLEETLHFDHAVRMAPVITEETTLQLEDIIKQRIRDQAWDDVVRKEKPKEDAYEYKKRLTLDHEKSKLSLAEIYEQEYIKLNQQKTAEEENPEHVEIQKMMDSLFLKLDALSNFHFIPKPPVPEIKVVSNLPAITMEEVAPVSVSDAALLAPEEIKEKNKAGDIKTAAEKTATDKKRERRKKKYQKRMKIKEKEKRRKLLEKSSVDQAGKYSKTVASEKLKQLTKTGKASFIKDEGKDKALKSSQAFFSKLQDQVKMQINDAKKTEKKKKKRQDISVHKLKL

SEQ ID NO: 52965 - protein, 462 aa, Homo sapiens
  Payload ID: 10554
  Gene Symbol: MPHOSPH10
  Gene Name: M-phase phosphoprotein 10 (U3 small nucleolar ribonucleoprotein)
  ENSP ID: ENSP00000475545
MAPQVWRRRTLERCLTEVGKATGRPECFLTIQEGLASKFTSLTKVLYDFNKILENGRIHGSPLQKLVIENFDDEQIWQQLELQNEPILQYFQNAVSETINDEDISLLPESEEQEREEDGSEIEADDKEDLEDLEEEEVSDMGNDDPEMGERAENSSKSDLRKSPVFSDEDSDLDFDISKLEQQSKVQNKGQGKPREKSIVDDKFFKLSEMEAYLENIEKEEERKDDNDEEEEDIDFFEDIDSDEDEGGLFGSKKLKSGKSSRNLKYKDFFDPVESDEDITNVHDDELDSNKEDDEIAEEEAEELSISETDEDDDLQENEDNKQHKESLKRVTFALPDDAETEDTGVLNVKKNSDEVKSSFEKRQEKMNEKIASLEKELLEKKPWQLQGEVTAQKRPENSLLEETLHFDHAVRMGMVPSSVVFMSVLFPWFHFIQRFGVVFLFPQLFILKTCKHMAWHGSSHL

SEQ ID NO: 52966 - protein, 160 aa, Homo sapiens
  Payload ID: 10555
  Gene Symbol: MPHOSPH6
  Gene Name: M-phase phosphoprotein 6
  Uniprot ID: Q99547
  ENSP ID: ENSP00000258169
MAAERKTRLSKNLLRMKFMQRGLDSETKKQLEEEEKKIISEEHWYLDLPELKEKESFIIEEQSFLLCEDLLYGRMSFRGFNPEVEKLMLQMNAKHKAEEVEDETVELDVSDEEMARRYETLVGTIGKKFARKRDHANYEEDENGDITPIKAKKMFLKPQD

SEQ ID NO: 52967 - protein, 55 aa, Homo sapiens
  Payload ID: 10555
  Gene Symbol: MPHOSPH6
  Gene Name: M-phase phosphoprotein 6
  ENSP ID: ENSP00000454900
MAAERKTRLSKNLLRMKFMQRGLDSETKKQLEEEEKKIISEEHWYLDLPELKEKE

SEQ ID NO: 52968 - protein, 142 aa, Homo sapiens
  Payload ID: 10555
  Gene Symbol: MPHOSPH6
  Gene Name: M-phase phosphoprotein 6
  ENSP ID: ENSP00000454996
MQRGLDSETKKQLEEEEKKIISEEHWYLDLPELKEKESFIIEEQSFLLCEDLLYGRMSFRGFNPEVEKLMLQMNAKHKAEEVEDETVELDVSDEEMARRYETLVGTIGKKFARKRDHANYEEDENGDITPIKAKKMFLKPQD

SEQ ID NO: 52969 - protein, 131 aa, Homo sapiens
  Payload ID: 10555
  Gene Symbol: MPHOSPH6
  Gene Name: M-phase phosphoprotein 6
  ENSP ID: ENSP00000456626
MQRGLDSETKKQLEEEEKKIISEEHWSFIIEEQSFLLCEDLLYGRMSFRGFNPEVEKLMLQMNAKHKAEEVEDETVELDVSDEEMARRYETLVGTIGKKFARKRDHANYEEDENGDITPIKAKKMFLKPQD

SEQ ID NO: 52970 - protein, 97 aa, Homo sapiens
  Payload ID: 10555
  Gene Symbol: MPHOSPH6
  Gene Name: M-phase phosphoprotein 6
  ENSP ID: ENSP00000457537
MAAERKTRLSKNLLRMKFMQRGLDSETKKQLEEEEKKIISEEHWYLDLPELKEKESFIIEEQSFLLCEDLLYGRMSFRGFNPEVEVFLHQVPFLLII

SEQ ID NO: 52971 - protein, 860 aa, Homo sapiens
  Payload ID: 10556
  Gene Symbol: MPHOSPH8
  Gene Name: M-phase phosphoprotein 8
  Uniprot ID: Q99549
  ENSP ID: ENSP00000355388
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 52972 - protein, 150 aa, Homo sapiens
  Payload ID: 10556
  Gene Symbol: MPHOSPH8
  Gene Name: M-phase phosphoprotein 8
  ENSP ID: ENSP00000405941
  MOD_RES (1)..(1): Any amino acid
XEETIKDYFEARLALLEPVFPIACHRLCEGPDFSTDFNYKPPQNIPEGSGILLFIFHANFLGKEVIARLCGPCSVQAVVLNDKFQLPVFLTGSRSVVQAGVQWRGLQLTGVLTSQAQAILPPQPPNYLGLKMTVILFTHSALLQVPINSS

SEQ ID NO: 52973 - protein, 311 aa, Homo sapiens
  Payload ID: 10556
  Gene Symbol: MPHOSPH8
  Gene Name: M-phase phosphoprotein 8
  ENSP ID: ENSP00000414663
  MOD_RES (1)..(1): Any amino acid
XKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSGEFGIILQNFSR

SEQ ID NO: 52974 - protein, 840 aa, Homo sapiens
  Payload ID: 10557
  Gene Symbol: MPHOSPH9
  Gene Name: M-phase phosphoprotein 9
  ENSP ID: ENSP00000304096
ASLASCEGNSSNKQVSSESQMGFFSLSSERNESVIHYPESTEPEIQQEMSTSQPDCNVDSCSVSSGYGTFCISELNLYKSKDPKEFMEHIDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRKNLF

SEQ ID NO: 52975 - protein, 363 aa, Homo sapiens
  Payload ID: 10557
  Gene Symbol: MPHOSPH9
  Gene Name: M-phase phosphoprotein 9
  ENSP ID: ENSP00000440007
  MOD_RES (1)..(1): Any amino acid
XQVVTAIQFGGKTMPRTDSCPAGAVPQPNSKPEIQQEMSTSQPDCNVDSCSVSSGYGTFCISELNLYKSKDPKEFMEHIDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGF

SEQ ID NO: 52976 - protein, 48 aa, Homo sapiens
  Payload ID: 10557
  Gene Symbol: MPHOSPH9
  Gene Name: M-phase phosphoprotein 9
  ENSP ID: ENSP00000440664
MEEFDLVKTLHKTSSSVGSDENSLHSLGLNLNTDSNAITSWAQKLKQN

SEQ ID NO: 52977 - protein, 126 aa, Homo sapiens
  Payload ID: 10557
  Gene Symbol: MPHOSPH9
  Gene Name: M-phase phosphoprotein 9
  ENSP ID: ENSP00000441298
MEEFDLVKTLHKTSSSVGSDENSLHSLGLNLNTDRSSPHLSTNGVSSFSGKTRPSVIQGTVEVLTSLMQELQNSGKTDSELWKNCETRWLQLFNLVEKQCQEQIVAQQEQFHNQIQNLKYSKKCPR

SEQ ID NO: 52978 - protein, 675 aa, Homo sapiens
  Payload ID: 10557
  Gene Symbol: MPHOSPH9
  Gene Name: M-phase phosphoprotein 9
  ENSP ID: ENSP00000441764
  MOD_RES (1)..(1): Any amino acid
XQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRKNLF

SEQ ID NO: 52979 - protein, 46 aa, Homo sapiens
  Payload ID: 10557
  Gene Symbol: MPHOSPH9
  Gene Name: M-phase phosphoprotein 9
  ENSP ID: ENSP00000442663
MEEFDLVKTLHKTSSSVGSDENSLHSLGLNLNTDREDQTICNSRYS

SEQ ID NO: 52980 - protein, 1153 aa, Homo sapiens
  Payload ID: 10557
  Gene Symbol: MPHOSPH9
  Gene Name: M-phase phosphoprotein 9
  ENSP ID: ENSP00000445859
MEEFDLVKTLHKTSSSVGSDENSLHSLGLNLNTDRSSPHLSTNGVSSFSGKTRPSVIQGTVEVLTSLMQELQNSGKTDSELWKNCEHIQEEIKNLVKLQTSSASLASCEGNSSNKQVSSESQMGFFSLSSERNESVIHYPESTEPEIQQEMSTSQPDCNVDSCSVSSGYGTFCISELNLYKSKDPKEFMEHIDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRFDILLDDLDTVPVSTLQRTNPRKQLQFLPLDDSEEKTYSEKATDNHVNHSSCPEPVPNGVKKVSVRTAWEKNKSVSYEQCKPVSVTPQGNDFEYTAKIRTLAETERFFDELTKEKDQIEAALSRMPSPGGRITLQTRLNQEALEDRLERINRELGSVRMTLKKFHVLRTSANL

SEQ ID NO: 52981 - protein, 89 aa, Homo sapiens
  Payload ID: 10557
  Gene Symbol: MPHOSPH9
  Gene Name: M-phase phosphoprotein 9
  ENSP ID: ENSP00000446249
MEEFDLVKTLHKTSSSVGSDENSLHSLGLNLNTDRSSPHLSTNGVSSFSGKTRPSVIQGTVEVLTSLMQELQNSGKTDSELWKNCENVE

SEQ ID NO: 52982 - protein, 84 aa, Homo sapiens
  Payload ID: 10557
  Gene Symbol: MPHOSPH9
  Gene Name: M-phase phosphoprotein 9
  ENSP ID: ENSP00000446334
MEEFDLVKTLHKTSSSVGSDENSLHSLGLNLNTDRSSPHLSTNGVSSFSGKTRPSVIQGTVEVLTSLMQELQNSGKTDSELWKN

SEQ ID NO: 52983 - protein, 215 aa, Homo sapiens
  Payload ID: 10557
  Gene Symbol: MPHOSPH9
  Gene Name: M-phase phosphoprotein 9
  ENSP ID: ENSP00000446362
  MOD_RES (1)..(1): Any amino acid
XSTPTKREIMLTPVTVAYSPKRSPKENLSPGFSHLLSKNESSPIRFDILLDDLDTVPVSTLQRTNPRKQLQFLPLDDSEEKTYSEKATDNHVNHSSCPEPVPNGVKKVSVRTAWEKNKSVSYEQCKPVSVTPQGNDFEYTAKIRTLAETERFFDELTKEKDQIEAALSRMPSPGGRITLQTRLNQTPQICEESSHKCAFAGHYVPCHLYDYRFQG

SEQ ID NO: 52984 - protein, 1183 aa, Homo sapiens
  Payload ID: 10557
  Gene Symbol: MPHOSPH9
  Gene Name: M-phase phosphoprotein 9
  Uniprot ID: Q99550
  ENSP ID: ENSP00000475489
MEEFDLVKTLHKTSSSVGSDENSLHSLGLNLNTDRSSPHLSTNGVSSFSGKTRPSVIQGTVEVLTSLMQELQNSGKTDSELWKNCETRWLQLFNLVEKQCQEQIVAQQEQFHNQIQHIQEEIKNLVKLQTSSASLASCEGNSSNKQVSSESQMGFFSLSSERNESVIHYPESTEPEIQQEMSTSQPDCNVDSCSVSSGYGTFCISELNLYKSKDPKEFMEHIDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRFDILLDDLDTVPVSTLQRTNPRKQLQFLPLDDSEEKTYSEKATDNHVNHSSCPEPVPNGVKKVSVRTAWEKNKSVSYEQCKPVSVTPQGNDFEYTAKIRTLAETERFFDELTKEKDQIEAALSRMPSPGGRITLQTRLNQEALEDRLERINRELGSVRMTLKKFHVLRTSANL

SEQ ID NO: 52985 - protein, 30 aa, Homo sapiens
  Payload ID: 10557
  Gene Symbol: MPHOSPH9
  Gene Name: M-phase phosphoprotein 9
  ENSP ID: ENSP00000475578
KNESSPIRYCSCVYITTYQSKKATPVSSSR

SEQ ID NO: 52986 - protein, 54 aa, Homo sapiens
  Payload ID: 10557
  Gene Symbol: MPHOSPH9
  Gene Name: M-phase phosphoprotein 9
  ENSP ID: ENSP00000475785
NQTFQNESRTSSTFPSVYTITSNDISVNTVDEENTVMVASASVSQSQLPGLGRI

SEQ ID NO: 52987 - protein, 163 aa, Homo sapiens
  Payload ID: 10557
  Gene Symbol: MPHOSPH9
  Gene Name: M-phase phosphoprotein 9
  ENSP ID: ENSP00000475923
RIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPSKS

SEQ ID NO: 52988 - protein, 179 aa, Homo sapiens
  Payload ID: 10558
  Gene Symbol: MPLKIP
  Gene Name: M-phase specific PLK1 interacting protein
  Uniprot ID: Q8TAP9
  ENSP ID: ENSP00000304553
MQRQNFRPPTPPYPGPGGGGWGSGSSFRGTPGGGGPRPPSPRDGYGSPHHTPPYGPRSRPYGSSHSPRHGGSFPGGRFGSPSPGGYPGSYSRSPAGSQQQFGYSPGQQQTHPQGSPRTSTPFGSGRVREKRMSNELENYFKPSMLEDPWAGLEPVSVVDISQQYSNTQTFTGKKGRYFC

SEQ ID NO: 52989 - protein, 635 aa, Homo sapiens
  Payload ID: 10559
  Gene Symbol: MPL
  Gene Name: MPL proto-oncogene, thrombopoietin receptor
  Uniprot ID: P40238
  ENSP ID: ENSP00000361548
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLCSSQAQMDYRRLQPSCLGTMPLSVCPPMAESGSCCTTHIANHSYLPLSYWQQP

SEQ ID NO: 52990 - protein, 549 aa, Homo sapiens
  Payload ID: 10559
  Gene Symbol: MPL
  Gene Name: MPL proto-oncogene, thrombopoietin receptor
  ENSP ID: ENSP00000414004
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRYRPRQAGDWRWTRWSRRPVNRHSWFAL

SEQ ID NO: 52991 - protein, 579 aa, Homo sapiens
  Payload ID: 10559
  Gene Symbol: MPL
  Gene Name: MPL proto-oncogene, thrombopoietin receptor
  ENSP ID: ENSP00000480273
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRYRPRQAGDWRWTRWSRRCKQAFLVRSVTPDLRPPPVRTYGFALPARHLWDSPRLLTL

SEQ ID NO: 52992 - protein, 471 aa, Homo sapiens
  Payload ID: 10560
  Gene Symbol: MPND
  Gene Name: MPN domain containing
  Uniprot ID: Q8N594
  ENSP ID: ENSP00000262966
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEMLLVEFYKGSPDLVRLQEPWSQEHTYLDKLKISLASRTPKDQSLCHVLEQVCGVLKQGS

SEQ ID NO: 52993 - protein, 451 aa, Homo sapiens
  Payload ID: 10560
  Gene Symbol: MPND
  Gene Name: MPN domain containing
  Uniprot ID: Q8N594
  ENSP ID: ENSP00000353015
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLIYQSLFLRGLSLVGWYHSHPHSPALPSLQDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 52994 - protein, 109 aa, Homo sapiens
  Payload ID: 10560
  Gene Symbol: MPND
  Gene Name: MPN domain containing
  ENSP ID: ENSP00000469057
DFHSHLTRSEVVGYLGGRWDVNSQMLTVLRAFPCRSRLGDAETAAAIEEEMLLVEFYKGSPDLVRLQEPWSQEHTYLDKLKISLASRTPKDQSLCHVLEQVCGVLKQGS

SEQ ID NO: 52995 - protein, 121 aa, Homo sapiens
  Payload ID: 10560
  Gene Symbol: MPND
  Gene Name: MPN domain containing
  ENSP ID: ENSP00000469230
RPLGKSPSEPAHPEATTPGKRVDSKIRVPVRYCMLGSRDLARNPHTLVEVTSFAAINKFQPFNVAVSSNVLFLLVCGPPCLGARGSGAQSVGSGRGSPAYQLHESWGLVCFVCYWYTVGAQ

SEQ ID NO: 52996 - protein, 419 aa, Homo sapiens
  Payload ID: 10560
  Gene Symbol: MPND
  Gene Name: MPN domain containing
  ENSP ID: ENSP00000470987
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEVPIPVQS

SEQ ID NO: 52997 - protein, 469 aa, Homo sapiens
  Payload ID: 10560
  Gene Symbol: MPND
  Gene Name: MPN domain containing
  ENSP ID: ENSP00000471189
  MOD_RES (1)..(1): Any amino acid
XEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 52998 - protein, 503 aa, Homo sapiens
  Payload ID: 10560
  Gene Symbol: MPND
  Gene Name: MPN domain containing
  ENSP ID: ENSP00000471715
GGPSGAEARGAGLQGRGAAEPWGERPPCSLSLSAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEMLLVEFYKGSPDLVRLQEPWSQEHTYLDKLKISLASRTPKDQSLCHVLEQVCGVLKQGS

SEQ ID NO: 52999 - protein, 501 aa, Homo sapiens
  Payload ID: 10560
  Gene Symbol: MPND
  Gene Name: MPN domain containing
  ENSP ID: ENSP00000471735
MAAPEPLSPAGGAGEEAPEEDEDEAEAEDPERPNAGAGGGRSGGGGSSVSGGGGGGGAGAGGCGGPGGALTRRAVTLRVLLKDALLEPGAGVLSIYYLGKKFLGDLQPDGRIMWQETGQTFNSPSAWATHCKKLVNPAKKSGCGWASVKYKGQKLDKYKATWLRLHQLHTPATAADESPASEGEEEELLMEEEEEDVLAGVSAEDKSRRPLGKSPSEPAHPEATTPGKRVDSKIRVPVRYCMLGSRDLARNPHTLVEVTSFAAINKFQPFNVAVSSNVLFLLDFHSHLTRSEVVGYLGGRWDVNSQMLTVLRAFPCRSRLGDAETAAAIEEEIYQSLFLRGLSLVGWYHSHPHSPALPSLQDIDAQMDYQLRLQGSSNGFQPCLALLCSPYYSGNPGPESKISPFWVMPPPEQRPSDYGIPMDVEMAYVQDSFLTNDILHEMMLLVEFYKGSPDLVRLQEPWSQEHTYLDKLKISLASRTPKDQSLCHVLEQVCGVLKQGS

SEQ ID NO: 53000 - protein, 176 aa, Homo sapiens
  Payload ID: 10561
  Gene Symbol: MPV17
  Gene Name: MpV17 mitochondrial inner membrane protein
  Uniprot ID: P39210
  ENSP ID: ENSP00000233545
MALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 53001 - protein, 120 aa, Homo sapiens
  Payload ID: 10561
  Gene Symbol: MPV17
  Gene Name: MpV17 mitochondrial inner membrane protein
  ENSP ID: ENSP00000349713
MCHLYEGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 53002 - protein, 176 aa, Homo sapiens; identical to SEQ ID NO: 53000
  Payload ID: 10561
  Gene Symbol: MPV17
  Gene Name: MpV17 mitochondrial inner membrane protein
  Uniprot ID: P39210
  ENSP ID: ENSP00000369383

SEQ ID NO: 53003 - protein, 110 aa, Homo sapiens
  Payload ID: 10561
  Gene Symbol: MPV17
  Gene Name: MpV17 mitochondrial inner membrane protein
  ENSP ID: ENSP00000382006
MALWRAYQRALAAHPWKVQVLTADFWGGRQHCWPHASSYTCRPRPPGLKDTLPAPHSKKPLLAPLPSAHETQKPQKNIAVCHPHEVTRSRMMEFGGVKTERKCISLGNVL

SEQ ID NO: 53004 - protein, 170 aa, Homo sapiens
  Payload ID: 10561
  Gene Symbol: MPV17
  Gene Name: MpV17 mitochondrial inner membrane protein
  ENSP ID: ENSP00000383955
MALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYVGRCPMCCCYLELLPVLEGTSALSLPHSIVSTLQ

SEQ ID NO: 53005 - protein, 191 aa, Homo sapiens
  Payload ID: 10561
  Gene Symbol: MPV17
  Gene Name: MpV17 mitochondrial inner membrane protein
  ENSP ID: ENSP00000384586
MALWRAYQRALAAHPWKVQVLTAAHPRRCPDNTCVPCIGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 53006 - protein, 113 aa, Homo sapiens
  Payload ID: 10561
  Gene Symbol: MPV17
  Gene Name: MpV17 mitochondrial inner membrane protein
  ENSP ID: ENSP00000385175
MALWRAYQRALAAHPWKVQVLTAGSLMGLGDIISQQLVERRGLQEHQRGRTLTMVSLGCGFVDYPDALITNYYLWPAVQLANFYLVPLHYRLAVVQCVAVIWNSYLSWKAHRL

SEQ ID NO: 53007 - protein, 171 aa, Homo sapiens
  Payload ID: 10561
  Gene Symbol: MPV17
  Gene Name: MpV17 mitochondrial inner membrane protein
  ENSP ID: ENSP00000385671
MALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYREDPASTTLVSIPPELRL

SEQ ID NO: 53008 - protein, 99 aa, Homo sapiens
  Payload ID: 10561
  Gene Symbol: MPV17
  Gene Name: MpV17 mitochondrial inner membrane protein
  ENSP ID: ENSP00000386000
MALWRAYQRALAAHPWKVQVLTAAAGGEAGSAGTPERPDSDHGVPGLWLCGPCGRRLVQGFGSVHPWHHQSGCTEEDVVGSGGLCPVFSRLLSPTGRGT

SEQ ID NO: 53009 - protein, 79 aa, Homo sapiens
  Payload ID: 10561
  Gene Symbol: MPV17
  Gene Name: MpV17 mitochondrial inner membrane protein
  ENSP ID: ENSP00000388043
MALWRAYQRALAAHPWKVQVLTADFWGGRQHCWPHASSYTCRPRPPGLKDTLPAPHSKKPLLAPLPSAHETQKPQKALW

SEQ ID NO: 53010 - protein, 99 aa, Homo sapiens; identical to SEQ ID NO: 53008
  Payload ID: 10561
  Gene Symbol: MPV17
  Gene Name: MpV17 mitochondrial inner membrane protein
  ENSP ID: ENSP00000403824

SEQ ID NO: 53011 - protein, 115 aa, Homo sapiens
  Payload ID: 10561
  Gene Symbol: MPV17
  Gene Name: MpV17 mitochondrial inner membrane protein
  ENSP ID: ENSP00000405235
MGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAV

SEQ ID NO: 53012 - protein, 121 aa, Homo sapiens
  Payload ID: 10561
  Gene Symbol: MPV17
  Gene Name: MpV17 mitochondrial inner membrane protein
  ENSP ID: ENSP00000406441
  MOD_RES (1)..(1): Any amino acid
XSLMGLGDIISQQLVERRGLQEHQRGRTLTMVSLGCGFVGPVVGGWYKVLDRFIPGTTKVDALKKMLLDQDYPDALITNYYLWPAVQLANFYLVPLHYRLAVVQCVAVIWNSYLSWKAHRL

SEQ ID NO: 53013 - protein, 147 aa, Homo sapiens
  Payload ID: 10562
  Gene Symbol: MPV17L
  Gene Name: MPV17 mitochondrial membrane protein-like
  Uniprot ID: Q2QL34
  ENSP ID: ENSP00000287594
MAGWWPALSRAARRHPWPTNVLLYGSLVSAGDALQQRLQGREANWRQTRRVATLVVTFHANFNYVWLRLLERALPGRAPHALLAKLLCDQVVGAPIAVSAFYVEWTDVLALCTADQLQPCSCSMENSLRWSLWFSLGHLHLFFPAEW

SEQ ID NO: 53014 - protein, 196 aa, Homo sapiens
  Payload ID: 10562
  Gene Symbol: MPV17L
  Gene Name: MPV17 mitochondrial membrane protein-like
  Uniprot ID: Q2QL34
  ENSP ID: ENSP00000379669
MAGWWPALSRAARRHPWPTNVLLYGSLVSAGDALQQRLQGREANWRQTRRVATLVVTFHANFNYVWLRLLERALPGRAPHALLAKLLCDQVVGAPIAVSAFYVGMSILQGKDDIFLDLKQKFWNTYLSGLMYWPFVQLTNFSLVPVQWRTAYAGVCGFLWATFICFSQQSGDGTFKSAFTILYTKGTSATEGYPKK

SEQ ID NO: 53015 - protein, 52 aa, Homo sapiens
  Payload ID: 10562
  Gene Symbol: MPV17L
  Gene Name: MPV17 mitochondrial membrane protein-like
  ENSP ID: ENSP00000457012
NYVWLRLLERALPGRAPHALLAKLLCDQVVGAPIAVSAFYVGSHSIPQAEVQ

SEQ ID NO: 53016 - protein, 147 aa, Homo sapiens; identical to SEQ ID NO: 53013
  Payload ID: 10562
  Gene Symbol: MPV17L
  Gene Name: MPV17 mitochondrial membrane protein-like
  Uniprot ID: Q2QL34
  ENSP ID: ENSP00000483043

SEQ ID NO: 53017 - protein, 196 aa, Homo sapiens; identical to SEQ ID NO: 53014
  Payload ID: 10562
  Gene Symbol: MPV17L
  Gene Name: MPV17 mitochondrial membrane protein-like
  Uniprot ID: Q2QL34
  ENSP ID: ENSP00000484675

SEQ ID NO: 53018 - protein, 52 aa, Homo sapiens; identical to SEQ ID NO: 53015
  Payload ID: 10562
  Gene Symbol: MPV17L
  Gene Name: MPV17 mitochondrial membrane protein-like
  ENSP ID: ENSP00000488434

SEQ ID NO: 53019 - protein, 206 aa, Homo sapiens
  Payload ID: 10563
  Gene Symbol: MPV17L2
  Gene Name: MPV17 mitochondrial membrane protein-like 2
  Uniprot ID: Q567V2
  ENSP ID: ENSP00000469836
MARGGWRRLRRLLSAGQLLFQGRALLVTNTLGCGALMAAGDGVRQSWEIRARPGQVFDPRRSASMFAVGCSMGPFLHYWYLSLDRLFPASGLRGFPNVLKKVLVDQLVASPLLGVWYFLGLGCLEGQTVGESCQELREKFWEFYKADWCVWPAAQFVNFLFVPPQFRVTYINGLTLGWDTYLSYLKYRSPVPLTPPGCVALDTRAD

SEQ ID NO: 53020 - protein, 708 aa, Homo sapiens
  Payload ID: 10564
  Gene Symbol: MRE11A
  Gene Name: MRE11 homolog A, double strand break repair nuclease
  Uniprot ID: P49959
  ENSP ID: ENSP00000325863
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRADTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 53021 - protein, 680 aa, Homo sapiens
  Payload ID: 10564
  Gene Symbol: MRE11A
  Gene Name: MRE11 homolog A, double strand break repair nuclease
  Uniprot ID: P49959
  ENSP ID: ENSP00000326094
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 53022 - protein, 707 aa, Homo sapiens
  Payload ID: 10564
  Gene Symbol: MRE11A
  Gene Name: MRE11 homolog A, double strand break repair nuclease
  ENSP ID: ENSP00000376933
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRDTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 53023 - protein, 711 aa, Homo sapiens
  Payload ID: 10564
  Gene Symbol: MRE11A
  Gene Name: MRE11 homolog A, double strand break repair nuclease
  Uniprot ID: P49959
  ENSP ID: ENSP00000385614
MNRNISHQKGDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRADTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 53024 - protein, 127 aa, Homo sapiens
  Payload ID: 10564
  Gene Symbol: MRE11A
  Gene Name: MRE11 homolog A, double strand break repair nuclease
  ENSP ID: ENSP00000439511
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHG

SEQ ID NO: 53025 - protein, 221 aa, Homo sapiens
  Payload ID: 10564
  Gene Symbol: MRE11A
  Gene Name: MRE11 homolog A, double strand break repair nuclease
  ENSP ID: ENSP00000440986
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRV

SEQ ID NO: 53026 - protein, 111 aa, Homo sapiens
  Payload ID: 10564
  Gene Symbol: MRE11A
  Gene Name: MRE11 homolog A, double strand break repair nuclease
  ENSP ID: ENSP00000442809
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNY

SEQ ID NO: 53027 - protein, 204 aa, Homo sapiens
  Payload ID: 10565
  Gene Symbol: MRGBP
  Gene Name: MRG/MORF4L binding protein
  Uniprot ID: Q9NV56
  ENSP ID: ENSP00000359518
MGEAEVGGGGAAGDKGPGEAATSPAEETVVWSPEVEVCLFHAMLGHKPVGVNRHFHMICIRDKFSQNIGRQVPSKVIWDHLSTMYDMQALHESEILPFPNPERNFVLPEEIIQEVREGKVMIEEEMKEEMKEDVDPHNGADDVFSSSGSLGKASEKSSKDKEKNSSDLGCKEGADKRKRSRVTDKVLTANSNPSSPSAAKRRRT

SEQ ID NO: 53028 - protein, 652 aa, Homo sapiens
  Payload ID: 10566
  Gene Symbol: MROH7-TTC4
  Gene Name: MROH7-TTC4 readthrough (NMD candidate)
  ENSP ID: ENSP00000392238
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHEPNSTISPPSCMTLILGSNETLSLDSSLLFSDTSTLTLSSQQDDAKDNSIHTVPLEENLESWSEMASIKVGQFPLGFPISNPAGKDAVTLQGIPEDGVSLLLPRLECNGAISAHCNLCLPGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFIAIQTDALGVPGAGASAGETHPSHWGS

SEQ ID NO: 53029 - protein, 1334 aa, Homo sapiens
  Payload ID: 10566
  Gene Symbol: MROH7-TTC4
  Gene Name: MROH7-TTC4 readthrough (NMD candidate)
  ENSP ID: ENSP00000410192
MALSPGANLVFHEDPKMTPSPPSCGAPGLGSGTIPQPHPDMAQVPMLNLLPSPGLALVPDLNDSLSPVSGEASGLVSENTPRPDDSRAIAPASLQITSSCSGEALDLDSKDVSRPDSQGRLCPASNPILSPSSTEAPRLSSGNHPQSNSEDAFKCLSSKIFKLGQRNSNPSRHELNPFIRHHSREGLVLGHCISRPSSKALLIPTSNSSLDLDSNPLLNMGSRNTSKLNLNVAPDSHGTLIPDTNETITLASHNISESVSKGAFSTTWSTSSKETMNVASSGHSRSDLSVTITQASYVTLIPGSSYGISLHSSTHEPNSTISPPSCMTLILGSNETLSLDSSLLFSDTSTLTLSSQQDDAKDNSIHTVPLEENLESWSEMASIKVGQFPLGFPISNPAGKDAVTLQGIPEGAFDEVTSCLVKVPEKTEGGNNMALVENVTTLQKSQDLLEAEGEKKTMIKKIMRQIQEEPLDSLSSSVRKQAMEILTQLSHTQPTLGMRERSELVNVCVHSVFSLPSVQAMQEKDEAKAETIQALYHQTLEALQTLLKALFIEDPTPAGLKSILEALGPWMNSGKAHERARAVNTNVSVLNHMLLTLPFFMPLGFPALGLLLGRLILHIGDPDEEIGCEALDGIIILYTILELQKRARDKEETNKKELYESNKHFLGPYNPVSPCQNILRVIEEFGDFLGPQQIKDLLLAALEGLKGSSEAPGKDSREMMQLASEVMLSSVLEWYRHRALEVIPEIMQGIYMQLSHIQEPRARQVALLPVSLLASSFMTEVVVALLMCPLPLNSNGAEMWRQLILCKPSCDVRDLLDLLLGSLKEKPVTKEGRASIVPLAAASGLCELLSVNSCMGRVRRIYPQLLLALLIQVHYHIGLNLPGCVAPPKDTKKGAQPSPFVPVRWVVKVVKTLLLRMGCSYETTFLEDQGGWELMEQVESHHRGVALLARAMVQYSCQELCRILYLLIPLLERGDEKHRITATAFFVELLQMEQVRRIPEEYSLGRMAEGLSHHDPIMKVLSIRGLVILARRSEKTAKVKALLPSMVKGLKNMDGMLVVEAVHNLKAVFKGRDQKLMDSAVYVEMLQILLPHFSDAREVVRSSCINLYGKVVQKLRAPRTQAMEEQLVSTLVPLLLTMQEGNSKVSQKCVKTLLRCSYFMAWELPKRAYSRKPWDNQQQTVAKICKCLVNTHRDSAFIFLSQSLEYAKNSRASLRKCSVMFIGSLVPCMESIMTEDRLNEVKAATPRGQRFHLLCPPLYSQPLEQAGSAERAKNLKRSPYLCRERHQKLIPGRILTWLVSSQLFLMRSVLQKNRPRPIKMRAMITLKKKTTRKL

SEQ ID NO: 53030 - protein, 627 aa, Homo sapiens; identical to SEQ ID NO: 48097
  Payload ID: 10566
  Gene Symbol: MROH7-TTC4
  Gene Name: MROH7-TTC4 readthrough (NMD candidate)
  ENSP ID: ENSP00000475315

SEQ ID NO: 53031 - protein, 393 aa, Homo sapiens
  Payload ID: 10567
  Gene Symbol: MRS2
  Gene Name: MRS2 magnesium transporter
  ENSP ID: ENSP00000274747
MECLRSLPCLLPRAMRLPRRTLCALALDVTSVGPPVAACGRRANLIGRSRAAQLCGPDRLRVAGEVHRFRTSDVSQATLASVAPVFTVYLKAVITPECLLILDYRNLNLEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNLESSLEEDHRIFWLITGIMFMGSGLIWRRLLSFLGRQLEAPLPPMMASLPKKTLLADRSMELKNSLRLDGLGSGRSILTNR

SEQ ID NO: 53032 - protein, 408 aa, Homo sapiens
  Payload ID: 10567
  Gene Symbol: MRS2
  Gene Name: MRS2 magnesium transporter
  Uniprot ID: Q9HD23
  ENSP ID: ENSP00000367604
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFERKKTELYQELGLQARDLRFQHVMSITVRNNRIIMRMEYLKAVITPECLLILDYRNLNLEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNLESSLEEDHRIFWLITGIMFMGSGLIWRRLLSFLGRQLEAPLPPMV

SEQ ID NO: 53033 - protein, 443 aa, Homo sapiens
  Payload ID: 10567
  Gene Symbol: MRS2
  Gene Name: MRS2 magnesium transporter
  Uniprot ID: Q9HD23
  ENSP ID: ENSP00000367637
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFERKKTELYQELGLQARDLRFQHVMSITVRNNRIIMRMEYLKAVITPECLLILDYRNLNLEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNLESSLEEDHRIFWLITGIMFMGSGLIWRRLLSFLGRQLEAPLPPMMASLPKKTLLADRSMELKNSLRLDGLGSGRSILTNR

SEQ ID NO: 53034 - protein, 182 aa, Homo sapiens
  Payload ID: 10567
  Gene Symbol: MRS2
  Gene Name: MRS2 magnesium transporter
  ENSP ID: ENSP00000387441
  MOD_RES (1)..(1): Any amino acid
XRAAQLCGPDRLRVAGEVHRFRTSDVSQATLASVAPVFTVTKFDKQGNVTSFERKKTELYQELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNL

SEQ ID NO: 53035 - protein, 446 aa, Homo sapiens
  Payload ID: 10567
  Gene Symbol: MRS2
  Gene Name: MRS2 magnesium transporter
  Uniprot ID: Q9HD23
  ENSP ID: ENSP00000399585
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFERKKTELYQELGLQARDLRFQHVMSITVRNNRIIMRMEKYSLLLESVASILQNSVSFMERQTEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNLESSLEEDHRIFWLITGIMFMGSGLIWRRLLSFLGRQLEAPLPPMMASLPKKTLLADRSMELKNSLRLDGLGSGRSILTNR

SEQ ID NO: 53036 - protein, 239 aa, Homo sapiens
  Payload ID: 10568
  Gene Symbol: MRTO4
  Gene Name: MRT4 homolog, ribosome maturation factor
  Uniprot ID: Q9UKD2
  ENSP ID: ENSP00000364320
MPKSKRDKKVSLTKTAKKGLELKQNLIEELRKCVDTYKYLFIFSVANMRNSKLKDIRNAWKHSRMFFGKNKVMMVALGRSPSDEYKDNLHQVSKRLRGEVGLLFTNRTKEEVNEWFTKYTEMDYARAGNKAAFTVSLDPGPLEQFPHSMEPQLRQLGLPTALKRGVVTLLSDYEVCKEGDVLTPEQARVLKLFGYEMAEFKVTIKYMWDSQSGRFQQMGDDLPESASESTEESDSEDDD

SEQ ID NO: 53037 - protein, 341 aa, Homo sapiens
  Payload ID: 10569
  Gene Symbol: MSANTD3-TMEFF1
  Gene Name: MSANTD3-TMEFF1 readthrough
  ENSP ID: ENSP00000424768
MLPEQLYFLQSPPEEEPEYHPDASAQELNVRESDVRVCDESSCKYGGVCKEDGDGLKCACQFQCHTNYIPVCGSNGDTYQNECFLRRAACKHQKEITVIARGPCYSDNGSGSGEGEEEGSGAEVHRKHSKCGPCKYKAECDEDAENVGCVCNIDCSGYSFNPVCASDGSSYNNPCFVREASCIKQEQIDIRHLGHCTDTDDTSLLGKKDDGLQYRPDVKDASDQREDVYIGNHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSDTSSRMV

SEQ ID NO: 53038 - protein, 303 aa, Homo sapiens
  Payload ID: 10570
  Gene Symbol: MSX1
  Gene Name: msh homeobox 1
  Uniprot ID: P28360
  ENSP ID: ENSP00000372170
MAPAADMTSLPLGVKVEDSAFGKPAGGGAGQAPSAAAATAAAMGADEEGAKPKVSPSLLPFSVEALMADHRKPGAKESALAPSEGVQAAGGSAQPLGVPPGSLGAPDAPSSPRPLGHFSVGGLLKLPEDALVKAESPEKPERTPWMQSPRFSPPPARRLSPPACTLRKHKTNRKPRTPFTTAQLLALERKFRQKQYLSIAERAEFSSSLSLTETQVKIWFQNRRAKAKRLQEAELEKLKMAAKPMLPPAAFGLSFPLGGPAAVAAAAGASLYGASGPFQRAALPVAPVGLYTAHVGYSMYHLT

SEQ ID NO: 53039 - protein, 267 aa, Homo sapiens
  Payload ID: 10571
  Gene Symbol: MSX2
  Gene Name: msh homeobox 2
  Uniprot ID: P35548
  ENSP ID: ENSP00000239243
MASPSKGNDLFSPDEEGPAVVAGPGPGPGGAEGAAEERRVKVSSLPFSVEALMSDKKPPKEASPLPAESASAGATLRPLLLSGHGAREAHSPGPLVKPFETASVKSENSEDGAAWMQEPGRYSPPPRHMSPTTCTLRKHKTNRKPRTPFTTSQLLALERKFRQKQYLSIAERAEFSSSLNLTETQVKIWFQNRRAKAKRLQEAELEKLKMAAKPMLPSSFSLPFPISSPLQAASIYGASYPFHRPVLPIPPVGLYATPVGYGMYHLS

SEQ ID NO: 53040 - protein, 134 aa, Homo sapiens
  Payload ID: 10571
  Gene Symbol: MSX2
  Gene Name: msh homeobox 2
  ENSP ID: ENSP00000427425
MASPSKGNDLFSPDEEGPAVVAGPGPGPGGAEGAAEERRVKVSSLPFSVEALMSDKKPPKEASPLPAESASAGATLRPLLLSGHGAREAHSPGPLVKPFETASVKSENSEDGAAWMQEPGRYSPPPSECAPGQE

SEQ ID NO: 53041 - protein, 851 aa, Homo sapiens
  Payload ID: 10572
  Gene Symbol: MSH5-SAPCD1
  Gene Name: MSH5-SAPCD1 readthrough (NMD candidate)
  ENSP ID: ENSP00000417871
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSQVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 53042 - protein, 264 aa, Homo sapiens
  Payload ID: 10572
  Gene Symbol: MSH5-SAPCD1
  Gene Name: MSH5-SAPCD1 readthrough (NMD candidate)
  ENSP ID: ENSP00000419220
  MOD_RES (1)..(1): Any amino acid
XHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLDWPRVSGQEGGD

SEQ ID NO: 53043 - protein, 29 aa, Homo sapiens
  Payload ID: 10572
  Gene Symbol: MSH5-SAPCD1
  Gene Name: MSH5-SAPCD1 readthrough (NMD candidate)
  ENSP ID: ENSP00000435414
  MOD_RES (1)..(1): Any amino acid
XMKLDLEDPNLDLNVFMSQEVLPAATSIL

SEQ ID NO: 53044 - protein, 851 aa, Homo sapiens; identical to SEQ ID NO: 53041
  Payload ID: 10572
  Gene Symbol: MSH5-SAPCD1
  Gene Name: MSH5-SAPCD1 readthrough (NMD candidate)
  ENSP ID: ENSP00000436555

SEQ ID NO: 53045 - protein, 264 aa, Homo sapiens; identical to SEQ ID NO: 53042
  Payload ID: 10572
  Gene Symbol: MSH5-SAPCD1
  Gene Name: MSH5-SAPCD1 readthrough (NMD candidate)
  ENSP ID: ENSP00000437010
  MOD_RES (1)..(1): Any amino acid

SEQ ID NO: 53046 - protein, 148 aa, Homo sapiens
  Payload ID: 10572
  Gene Symbol: MSH5-SAPCD1
  Gene Name: MSH5-SAPCD1 readthrough (NMD candidate)
  ENSP ID: ENSP00000446749
MGSQGSGGVPLVQAPYTVLLLPLGTSRQDPGAQSFFLWLRRMQALEREQDALWQGLELLQHGQAWFEDHLREAQRQQLHLGALGENFLTDLHSEPGRPPLAQIQKVNICLQNLIHEKELSRQQKGVTQPKEEMAQRGCTKGPRGPTRV

SEQ ID NO: 53047 - protein, 148 aa, Homo sapiens; identical to SEQ ID NO: 53046
  Payload ID: 10572
  Gene Symbol: MSH5-SAPCD1
  Gene Name: MSH5-SAPCD1 readthrough (NMD candidate)
  Uniprot ID: Q5SSQ6
  ENSP ID: ENSP00000447344

SEQ ID NO: 53048 - protein, 148 aa, Homo sapiens; identical to SEQ ID NO: 53046
  Payload ID: 10572
  Gene Symbol: MSH5-SAPCD1
  Gene Name: MSH5-SAPCD1 readthrough (NMD candidate)
  Uniprot ID: Q5SSQ6
  ENSP ID: ENSP00000448208

SEQ ID NO: 53049 - protein, 148 aa, Homo sapiens; identical to SEQ ID NO: 53046
  Payload ID: 10572
  Gene Symbol: MSH5-SAPCD1
  Gene Name: MSH5-SAPCD1 readthrough (NMD candidate)
  ENSP ID: ENSP00000450332

SEQ ID NO: 53050 - protein, 264 aa, Homo sapiens; identical to SEQ ID NO: 53042
  Payload ID: 10572
  Gene Symbol: MSH5-SAPCD1
  Gene Name: MSH5-SAPCD1 readthrough (NMD candidate)
  ENSP ID: ENSP00000454400
  MOD_RES (1)..(1): Any amino acid

SEQ ID NO: 53051 - protein, 264 aa, Homo sapiens; identical to SEQ ID NO: 53042
  Payload ID: 10572
  Gene Symbol: MSH5-SAPCD1
  Gene Name: MSH5-SAPCD1 readthrough (NMD candidate)
  ENSP ID: ENSP00000457337
  MOD_RES (1)..(1): Any amino acid

SEQ ID NO: 53052 - protein, 851 aa, Homo sapiens; identical to SEQ ID NO: 53041
  Payload ID: 10572
  Gene Symbol: MSH5-SAPCD1
  Gene Name: MSH5-SAPCD1 readthrough (NMD candidate)
  ENSP ID: ENSP00000457803

SEQ ID NO: 53053 - protein, 264 aa, Homo sapiens; identical to SEQ ID NO: 53042
  Payload ID: 10572
  Gene Symbol: MSH5-SAPCD1
  Gene Name: MSH5-SAPCD1 readthrough (NMD candidate)
  ENSP ID: ENSP00000461962
  MOD_RES (1)..(1): Any amino acid

SEQ ID NO: 53054 - protein, 851 aa, Homo sapiens; identical to SEQ ID NO: 53041
  Payload ID: 10572
  Gene Symbol: MSH5-SAPCD1
  Gene Name: MSH5-SAPCD1 readthrough (NMD candidate)
  ENSP ID: ENSP00000462078

SEQ ID NO: 53055 - protein, 496 aa, Homo sapiens
  Payload ID: 10572
  Gene Symbol: MSH5-SAPCD1
  Gene Name: MSH5-SAPCD1 readthrough (NMD candidate)
  ENSP ID: ENSP00000463117
TVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 53056 - protein, 29 aa, Homo sapiens
  Payload ID: 10572
  Gene Symbol: MSH5-SAPCD1
  Gene Name: MSH5-SAPCD1 readthrough (NMD candidate)
  ENSP ID: ENSP00000463231
  MOD_RES (1)..(1): Any amino acid
XMKLDLEDPNLDLNVFMSQEVLPAATSIL

SEQ ID NO: 53057 - protein, 496 aa, Homo sapiens; identical to SEQ ID NO: 53055
  Payload ID: 10572
  Gene Symbol: MSH5-SAPCD1
  Gene Name: MSH5-SAPCD1 readthrough (NMD candidate)
  ENSP ID: ENSP00000463303

SEQ ID NO: 53058 - protein, 29 aa, Homo sapiens
  Payload ID: 10572
  Gene Symbol: MSH5-SAPCD1
  Gene Name: MSH5-SAPCD1 readthrough (NMD candidate)
  ENSP ID: ENSP00000463412
  MOD_RES (1)..(1): Any amino acid
XMKLDLEDPNLDLNVFMSQEVLPAATSIL

SEQ ID NO: 53059 - protein, 29 aa, Homo sapiens
  Payload ID: 10572
  Gene Symbol: MSH5-SAPCD1
  Gene Name: MSH5-SAPCD1 readthrough (NMD candidate)
  ENSP ID: ENSP00000463617
  MOD_RES (1)..(1): Any amino acid
XMKLDLEDPNLDLNVFMSQEVLPAATSIL

SEQ ID NO: 53060 - protein, 264 aa, Homo sapiens; identical to SEQ ID NO: 53042
  Payload ID: 10572
  Gene Symbol: MSH5-SAPCD1
  Gene Name: MSH5-SAPCD1 readthrough (NMD candidate)
  ENSP ID: ENSP00000463749
  MOD_RES (1)..(1): Any amino acid

SEQ ID NO: 53061 - protein, 29 aa, Homo sapiens
  Payload ID: 10572
  Gene Symbol: MSH5-SAPCD1
  Gene Name: MSH5-SAPCD1 readthrough (NMD candidate)
  ENSP ID: ENSP00000463789
  MOD_RES (1)..(1): Any amino acid
XMKLDLEDPNLDLNVFMSQEVLPAATSIL

SEQ ID NO: 53062 - protein, 29 aa, Homo sapiens
  Payload ID: 10572
  Gene Symbol: MSH5-SAPCD1
  Gene Name: MSH5-SAPCD1 readthrough (NMD candidate)
  ENSP ID: ENSP00000464606
  MOD_RES (1)..(1): Any amino acid
XMKLDLEDPNLDLNVFMSQEVLPAATSIL

SEQ ID NO: 53063 - protein, 460 aa, Homo sapiens
  Payload ID: 10573
  Gene Symbol: MSS51
  Gene Name: MSS51 mitochondrial translational activator
  Uniprot ID: Q4VC12
  ENSP ID: ENSP00000299432
MAPRSRRRRHKKPPSSVAPIIMAPTTIVTPVPLTPSKPGPSIDTLGFFSLDDNVPGLSQLILQKLNMKSYEEYKLVVDGGTPVSGFGFRCPQEMFQRMEDTFRFCAHCRALPSGLSDSKVLRHCKRCRNVYYCGPECQKSDWPAHRRVCQELRLVAVDRLMEWLLVTGDFVLPSGPWPWPPEAVQDWDSWFSMKGLHLDATLDAVLVSHAVTTLWASVGRPRPDPDVLQGSLKRLLTDVLSRPLTLGLGLRALGIDVRRTGGSTVHVVGASHVETFLTRPGDYDELGYMFPGHLGLRVVMVGVDVATGFSQSTSTSPLEPGTIQLSAHRGLYHDFWEEQVETGQTHHPDLVAAFHPGFHSSPDLMEAWLPTLLLLRDYKIPTLITVYSHQELVSSLQILVELDTHITAFGSNPFMSLKPEQVYSSPNKQPVYCSAYYIMFLGSSCQLDNRQLEEKVDGGI

SEQ ID NO: 53064 - protein, 460 aa, Homo sapiens; identical to SEQ ID NO: 53063
  Payload ID: 10573
  Gene Symbol: MSS51
  Gene Name: MSS51 mitochondrial translational activator
  Uniprot ID: Q4VC12
  ENSP ID: ENSP00000362003

SEQ ID NO: 53065 - protein, 181 aa, Homo sapiens
  Payload ID: 10573
  Gene Symbol: MSS51
  Gene Name: MSS51 mitochondrial translational activator
  ENSP ID: ENSP00000435203
MAPRSRRRRHKKPPSSVAPIIMAPTTIVTPVPLTPSKPGPSIDTLGFFSLDDNVPGLSQLILQKLNMKSYEEYKLVVDGGTPVSGFGFRCPQEMFQRMEDTFRFCAHCRALPSGLSDSKVLRHCKRCRNVYYCGPECQKSDWPAHRRVCQELRLVAVDRLMEWLLVTEHLNFTPGTWHNSA

SEQ ID NO: 53066 - protein, 327 aa, Homo sapiens
  Payload ID: 10574
  Gene Symbol: MLST8
  Gene Name: MTOR associated protein, LST8 homolog
  ENSP ID: ENSP00000301724
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTGEPRPGLPHPWPPALASRASPPRLQLPLCWGRLLGLHLRS

SEQ ID NO: 53067 - protein, 325 aa, Homo sapiens
  Payload ID: 10574
  Gene Symbol: MLST8
  Gene Name: MTOR associated protein, LST8 homolog
  Uniprot ID: Q9BVC4
  ENSP ID: ENSP00000371888
MNTSPGTVGSDPVILATAGYDHTVRFWQAHSGICTRTVQHQDSVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 53068 - protein, 326 aa, Homo sapiens
  Payload ID: 10574
  Gene Symbol: MLST8
  Gene Name: MTOR associated protein, LST8 homolog
  Uniprot ID: Q9BVC4
  ENSP ID: ENSP00000380313
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 53069 - protein, 116 aa, Homo sapiens
  Payload ID: 10574
  Gene Symbol: MLST8
  Gene Name: MTOR associated protein, LST8 homolog
  ENSP ID: ENSP00000454235
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRG

SEQ ID NO: 53070 - protein, 72 aa, Homo sapiens
  Payload ID: 10574
  Gene Symbol: MLST8
  Gene Name: MTOR associated protein, LST8 homolog
  ENSP ID: ENSP00000454629
MNTSPGTVGSDPVILATAGYDHTVRFWQAHSGICTRTVQHQDSQVNALEVTPDRSMIAAAACVPRLPAHPHV

SEQ ID NO: 53071 - protein, 202 aa, Homo sapiens
  Payload ID: 10574
  Gene Symbol: MLST8
  Gene Name: MTOR associated protein, LST8 homolog
  ENSP ID: ENSP00000454698
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGG

SEQ ID NO: 53072 - protein, 326 aa, Homo sapiens; identical to SEQ ID NO: 53068
  Payload ID: 10574
  Gene Symbol: MLST8
  Gene Name: MTOR associated protein, LST8 homolog
  Uniprot ID: Q9BVC4
  ENSP ID: ENSP00000455046

SEQ ID NO: 53073 - protein, 198 aa, Homo sapiens
  Payload ID: 10574
  Gene Symbol: MLST8
  Gene Name: MTOR associated protein, LST8 homolog
  ENSP ID: ENSP00000455458
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTAPRHLLG

SEQ ID NO: 53074 - protein, 131 aa, Homo sapiens
  Payload ID: 10574
  Gene Symbol: MLST8
  Gene Name: MTOR associated protein, LST8 homolog
  ENSP ID: ENSP00000455475
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRQSSSWVTRAGLSTSGT

SEQ ID NO: 53075 - protein, 51 aa, Homo sapiens
  Payload ID: 10574
  Gene Symbol: MLST8
  Gene Name: MTOR associated protein, LST8 homolog
  ENSP ID: ENSP00000455642
MNTSPGTVGSDPVILATAGYDHTVRFWQAHSGICTRTVQHQDSQVNALEVT

SEQ ID NO: 53076 - protein, 116 aa, Homo sapiens; identical to SEQ ID NO: 53069
  Payload ID: 10574
  Gene Symbol: MLST8
  Gene Name: MTOR associated protein, LST8 homolog
  ENSP ID: ENSP00000455850

SEQ ID NO: 53077 - protein, 166 aa, Homo sapiens
  Payload ID: 10574
  Gene Symbol: MLST8
  Gene Name: MTOR associated protein, LST8 homolog
  ENSP ID: ENSP00000456046
MNTSPGTVGSDPVILATAGYDHTVRFWQAHSGICTRTVQHQDSQVNALEVTPDRSMIAAAVQPVSLGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTD

SEQ ID NO: 53078 - protein, 72 aa, Homo sapiens; identical to SEQ ID NO: 53070
  Payload ID: 10574
  Gene Symbol: MLST8
  Gene Name: MTOR associated protein, LST8 homolog
  ENSP ID: ENSP00000456063

SEQ ID NO: 53079 - protein, 72 aa, Homo sapiens; identical to SEQ ID NO: 53070
  Payload ID: 10574
  Gene Symbol: MLST8
  Gene Name: MTOR associated protein, LST8 homolog
  ENSP ID: ENSP00000456076

SEQ ID NO: 53080 - protein, 326 aa, Homo sapiens; identical to SEQ ID NO: 53068
  Payload ID: 10574
  Gene Symbol: MLST8
  Gene Name: MTOR associated protein, LST8 homolog
  Uniprot ID: Q9BVC4
  ENSP ID: ENSP00000456405

SEQ ID NO: 53081 - protein, 275 aa, Homo sapiens
  Payload ID: 10574
  Gene Symbol: MLST8
  Gene Name: MTOR associated protein, LST8 homolog
  ENSP ID: ENSP00000456944
MNTSPGTVGSDPVILATAGYDHTVRFWQAHSGICTRTVQHQDSQVNALEVTPDRSMIAAAVQPVSLGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESS

SEQ ID NO: 53082 - protein, 326 aa, Homo sapiens; identical to SEQ ID NO: 53068
  Payload ID: 10574
  Gene Symbol: MLST8
  Gene Name: MTOR associated protein, LST8 homolog
  Uniprot ID: Q9BVC4
  ENSP ID: ENSP00000457870

SEQ ID NO: 53083 - protein, 71 aa, Homo sapiens
  Payload ID: 10574
  Gene Symbol: MLST8
  Gene Name: MTOR associated protein, LST8 homolog
  ENSP ID: ENSP00000459612
MNTSPGTVGSDPVILATAGYDHTVRFWQAHSGICTRTVQHQDSVNALEVTPDRSMIAAAACVPRLPAHPHV

SEQ ID NO: 53084 - protein, 24 aa, Homo sapiens
  Payload ID: 10575
  Gene Symbol: MTRNR2L1
  Gene Name: MT-RNR2-like 1
  Uniprot ID: P0CJ68
  ENSP ID: ENSP00000439228
MAPRGFSCLLLSTSEIDLPVKRRT

SEQ ID NO: 53085 - protein, 24 aa, Homo sapiens
  Payload ID: 10576
  Gene Symbol: MTRNR2L10
  Gene Name: MT-RNR2-like 10
  Uniprot ID: P0CJ77
  ENSP ID: ENSP00000442159
MTTRGFSCLLLLIREIDLSAKRRI

SEQ ID NO: 53086 - protein, 24 aa, Homo sapiens
  Payload ID: 10577
  Gene Symbol: MTRNR2L11
  Gene Name: MT-RNR2-like 11 (pseudogene)
  Uniprot ID: S4R3Y5
  ENSP ID: ENSP00000474861
MATRGFSCLLLVISEIDLSVKRWV

SEQ ID NO: 53087 - protein, 24 aa, Homo sapiens
  Payload ID: 10578
  Gene Symbol: MTRNR2L12
  Gene Name: MT-RNR2-like 12
  Uniprot ID: P0DMP1
  ENSP ID: ENSP00000468991
MAPRGFSCLLLSTSEIDLPVKRRA

SEQ ID NO: 53088 - protein, 24 aa, Homo sapiens
  Payload ID: 10579
  Gene Symbol: MTRNR2L13
  Gene Name: MT-RNR2-like 13
  Uniprot ID: S4R3P1
  ENSP ID: ENSP00000474570
MDTQGFSCLLLLISEIDLSVKRRI

SEQ ID NO: 53089 - protein, 24 aa, Homo sapiens
  Payload ID: 10580
  Gene Symbol: MTRNR2L3
  Gene Name: MT-RNR2-like 3
  Uniprot ID: P0CJ70
  ENSP ID: ENSP00000443339
MATRRFSCLLLSTSEIDLSVKRRI

SEQ ID NO: 53090 - protein, 28 aa, Homo sapiens
  Payload ID: 10581
  Gene Symbol: MTRNR2L4
  Gene Name: MT-RNR2-like 4
  Uniprot ID: P0CJ71
  ENSP ID: ENSP00000382856
MATQGFSCLLLSVSEIDLSMKRQYKQIR

SEQ ID NO: 53091 - protein, 24 aa, Homo sapiens
  Payload ID: 10582
  Gene Symbol: MTRNR2L5
  Gene Name: MT-RNR2-like 5
  Uniprot ID: P0CJ72
  ENSP ID: ENSP00000437910
MATPGFSCLLLSTSEIDLPMKRRV

SEQ ID NO: 53092 - protein, 24 aa, Homo sapiens
  Payload ID: 10583
  Gene Symbol: MTRNR2L6
  Gene Name: MT-RNR2-like 6
  Uniprot ID: P0CJ73
  ENSP ID: ENSP00000473686
MTPRGFSCLLLPTSETDLPVKRRT

SEQ ID NO: 53093 - protein, 24 aa, Homo sapiens
  Payload ID: 10583
  Gene Symbol: MTRNR2L6
  Gene Name: MT-RNR2-like 6
  Uniprot ID: P0CJ73
  ENSP ID: ENSP00000488809
MTPRGFSCLLLPTSETDLPVKRRT

SEQ ID NO: 53094 - protein, 24 aa, Homo sapiens
  Payload ID: 10584
  Gene Symbol: MTRNR2L7
  Gene Name: MT-RNR2-like 7
  Uniprot ID: P0CJ74
  ENSP ID: ENSP00000439985
MATGGFGCLLLLIREIDLSVKRQI

SEQ ID NO: 53095 - protein, 24 aa, Homo sapiens
  Payload ID: 10585
  Gene Symbol: MTRNR2L8
  Gene Name: MT-RNR2-like 8
  Uniprot ID: P0CJ75
  ENSP ID: ENSP00000439666
MAPRGFSCLLLSTSEIDLPVKRRA

SEQ ID NO: 53096 - protein, 273 aa, Homo sapiens
  Payload ID: 10586
  Gene Symbol: MUC1
  Gene Name: mucin 1, cell surface associated
  Uniprot ID: P15941
  ENSP ID: ENSP00000338983
MTPGTQSPFFLLLLLTVLTVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53097 - protein, 203 aa, Homo sapiens
  Payload ID: 10586
  Gene Symbol: MUC1
  Gene Name: mucin 1, cell surface associated
  Uniprot ID: P15941
  ENSP ID: ENSP00000339690
MTPGTQSPFFLLLLLTVLTVVTGSGHASSTPGGEKETSATQRSSVPSSTEKNAIPAPTTTKSCRETFLKCFCRFINKGVFWASPILSSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53098 - protein, 166 aa, Homo sapiens
  Payload ID: 10586
  Gene Symbol: MUC1
  Gene Name: mucin 1, cell surface associated
  Uniprot ID: P15941
  ENSP ID: ENSP00000342814
MTPGTQSPFFLLLLLTVLTATTAPKPATVVTGSGHASSTPGGEKETSATQRSSVPSSTEKNASGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53099 - protein, 241 aa, Homo sapiens
  Payload ID: 10586
  Gene Symbol: MUC1
  Gene Name: mucin 1, cell surface associated
  ENSP ID: ENSP00000343482
MTPGTQSPFFLLLLLTVLTATTAPKPATVVTGSGHASSTPGGEKETSATQRSSVPSSTEKNAFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53100 - protein, 168 aa, Homo sapiens
  Payload ID: 10586
  Gene Symbol: MUC1
  Gene Name: mucin 1, cell surface associated
  Uniprot ID: P15941
  ENSP ID: ENSP00000357374
MTPGTQSPFFLLLLLTVLTVVTGSGHASSTPGGEKETSATQRSSVPSSTEKNALSTGVSFFFLSFHISNLQFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 53101 - protein, 255 aa, Homo sapiens
  Payload ID: 10586
  Gene Symbol: MUC1
  Gene Name: mucin 1, cell surface associated
  Uniprot ID: P15941
  ENSP ID: ENSP00000357375
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53102 - protein, 264 aa, Homo sapiens
  Payload ID: 10586
  Gene Symbol: MUC1
  Gene Name: mucin 1, cell surface associated
  Uniprot ID: P15941
  ENSP ID: ENSP00000357377
MTPGTQSPFFLLLLLTVLTATTAPKPATVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53103 - protein, 198 aa, Homo sapiens
  Payload ID: 10586
  Gene Symbol: MUC1
  Gene Name: mucin 1, cell surface associated
  Uniprot ID: P15941
  ENSP ID: ENSP00000357378
MTPGTQSPFFLLLLLTVLTVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSGCLSVPPKELRAAGHLSSPGYLPSYERVPHLPHPWALCAP

SEQ ID NO: 53104 - protein, 159 aa, Homo sapiens
  Payload ID: 10586
  Gene Symbol: MUC1
  Gene Name: mucin 1, cell surface associated
  Uniprot ID: P15941
  ENSP ID: ENSP00000357381
MTPGTQSPFFLLLLLTVLTATTAPKPATVVTGSGHASSTPGGEKETSATQRSSVPSSTEKNAFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 53105 - protein, 230 aa, Homo sapiens
  Payload ID: 10586
  Gene Symbol: MUC1
  Gene Name: mucin 1, cell surface associated
  Uniprot ID: P15941
  ENSP ID: ENSP00000357383
MTPGTQSPFFLLLLLTVLTVVTGSGHASSTPGGEKETSATQRSSVPSSTEKNAIPAPTTTKSCRETFLKWPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53106 - protein, 268 aa, Homo sapiens
  Payload ID: 10586
  Gene Symbol: MUC1
  Gene Name: mucin 1, cell surface associated
  ENSP ID: ENSP00000388172
MTPGTQSPFFLLLLLTVLTATTAPKPATVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKEWRVDRERLA

SEQ ID NO: 53107 - protein, 229 aa, Homo sapiens
  Payload ID: 10586
  Gene Symbol: MUC1
  Gene Name: mucin 1, cell surface associated
  ENSP ID: ENSP00000389098
MTPGTQSPFFLLLLLTVLTVVTGSGHASSTPGGEKETSATQRSSVPSSTEKNAIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53108 - protein, 85 aa, Homo sapiens
  Payload ID: 10586
  Gene Symbol: MUC1
  Gene Name: mucin 1, cell surface associated
  ENSP ID: ENSP00000478068
TEAASRYNLTISDVSVWGWGARLGHRAAGAGLCSGCAGHCLSHCLGCLSVPPKELRAAGHLSSPGYLPSYERVPHLPHPWALCAP

SEQ ID NO: 53109 - protein, 228 aa, Homo sapiens
  Payload ID: 10586
  Gene Symbol: MUC1
  Gene Name: mucin 1, cell surface associated
  ENSP ID: ENSP00000479471
ASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKEWRVDRERLA

SEQ ID NO: 53110 - protein, 1262 aa, Homo sapiens
  Payload ID: 10586
  Gene Symbol: MUC1
  Gene Name: mucin 1, cell surface associated
  ENSP ID: ENSP00000480333
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPQAHGVTSAPDTRPAPGSTAPPAHGVTSAPDTRPAPGSTAPPAHGVTSAPDTRSAPGSTAPAAHGVTSAPDTRSVPGSTAPQAHGVTSAPDTRPAPGSTAPPAHGVTSAPDTRPVPGSTAPPAHGVTSAPDTRPAPGSTAPPAHGVTSAPDTRPAPGSTAPQAHGVTSAPDTRPAPGSTAPPAHGVTSAPDTRPAPGSTAPPAHGVTSAPDTRPAPGSTAPAAHGVTSAPDTRPAPGSTAPQAHGVTSAPDTRPAPGSTAPPAHGVTSAPDTRPAPGSTAPPAHGVTSAPDTRPAPGSTAPPAHGVTSAPDTRPAPGSTAPAAHGVTSAPDTRPAPGSTAPQAHGVTSAPDTRPAPGSTAPPAHGVTSAPDTRPAPGSTAPPAHGVTSAPDTRPAPGSTAPPTHGVTSAPDTSPAPGSTAPPAHGVTSAPDTRPAPGYTAPAAHGVTSAPDTRPAPGSTAPQAHGVTSAPDTRPAPGSTAPPAHGVTSAPDTRPAPGSTAPPAHGVTSAPDTRPAPGSTAPPAHGVTSAPESRPAPGSTARAAHGVTSAPESRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPSPPGSTAPPAHGVTSAPDTRPAPGSTAPPVHGVTSAPDTRPAPGSTAPPAHGVTSAPDTRPAPGSTAPPAHGVTSAPDTRPAPGSTAPPAHGVTSAPDTRRAPGSTPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53111 - protein, 135 aa, Homo sapiens
  Payload ID: 10586
  Gene Symbol: MUC1
  Gene Name: mucin 1, cell surface associated
  ENSP ID: ENSP00000480335
MTPGTQSPFFLLLLLTVLTATTAPKPATVVTGSGHASSTPGGEKETSATQRSSVPSSTEKNAALHQAQLLLWCTTAPLPGLPQPQPARALHSQFPATTLILLPPLPAIAPRLMPVALTIARSQHRLLPRAAERHF

SEQ ID NO: 53112 - protein, 475 aa, Homo sapiens
  Payload ID: 10586
  Gene Symbol: MUC1
  Gene Name: mucin 1, cell surface associated
  ENSP ID: ENSP00000481231
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53113 - protein, 126 aa, Homo sapiens
  Payload ID: 10586
  Gene Symbol: MUC1
  Gene Name: mucin 1, cell surface associated
  ENSP ID: ENSP00000482688
MTPGTQSPFFLLLLLTVLTVVTGSGHASSTPGGEKETSATQRSSVPSSTEKNAALHQAQLLLWCTTAPLPGLPQPQPARALHSQFPATTLILLPPLPAIAPRLMPVALTIARSQHRLLPRAAERHF

SEQ ID NO: 53114 - protein, 123 aa, Homo sapiens
  Payload ID: 10586
  Gene Symbol: MUC1
  Gene Name: mucin 1, cell surface associated
  ENSP ID: ENSP00000482988
MTPGTQSPFFLLLLLTVLTATTAPKPATVVTGSGHASSTPGGEKETSATQRSSVPSSTEKNALSTGVSFFFLSFHISNLQFNSSLEDPSTDYYQELQRDISEMFLQIYKQGGFLGLSNIKFSE

SEQ ID NO: 53115 - protein, 96 aa, Homo sapiens
  Payload ID: 10586
  Gene Symbol: MUC1
  Gene Name: mucin 1, cell surface associated
  ENSP ID: ENSP00000483128
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFSE

SEQ ID NO: 53116 - protein, 189 aa, Homo sapiens
  Payload ID: 10586
  Gene Symbol: MUC1
  Gene Name: mucin 1, cell surface associated
  ENSP ID: ENSP00000483473
MTPGTQSPFFLLLLLTVLTATTAPKPATVVTGSGHASSTPGGEKETSATQRSSVPSSTEKNAFNSSLEDPSTDYYQELQRDISEMSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53117 - protein, 239 aa, Homo sapiens
  Payload ID: 10586
  Gene Symbol: MUC1
  Gene Name: mucin 1, cell surface associated
  ENSP ID: ENSP00000483482
MTPGTQSPFFLLLLLTVLTATTAPKPATVVTGSGHASSTPGGEKETSATQRSSVPSSTEKNAIPAPTTTKSCRETFLKWPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53118 - protein, 213 aa, Homo sapiens
  Payload ID: 10586
  Gene Symbol: MUC1
  Gene Name: mucin 1, cell surface associated
  ENSP ID: ENSP00000483581
MTPGTQSPFFLLLLLTVLTGSGHASSTPGGEKETSATQRSSVPSSTEKNAVSMTSSVLSSHSPGSGSSTTQGQDVTLAPATEPASGSAATWGQDVTSVPVTRPALGSTTPPAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53119 - protein, 80 aa, Homo sapiens
  Payload ID: 10586
  Gene Symbol: MUC1
  Gene Name: mucin 1, cell surface associated
  ENSP ID: ENSP00000484006
MTPGTQSPFFLLLLLTVLTATTAPKPATVVTGSGHASSTPGGEKETSATQRSSVPSSTEKNAIPAPTTTKSCRETFLKCE

SEQ ID NO: 53120 - protein, 149 aa, Homo sapiens
  Payload ID: 10586
  Gene Symbol: MUC1
  Gene Name: mucin 1, cell surface associated
  ENSP ID: ENSP00000484730
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFSLGLGCQAGASRCWCWSVFWLRWPLSISLPWLSVSAAERTTGSWTSFQPGIPTIL

SEQ ID NO: 53121 - protein, 484 aa, Homo sapiens
  Payload ID: 10586
  Gene Symbol: MUC1
  Gene Name: mucin 1, cell surface associated
  ENSP ID: ENSP00000484824
MTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 53122 - protein, 94 aa, Homo sapiens
  Payload ID: 10587
  Gene Symbol: MUC12
  Gene Name: mucin 12, cell surface associated
  ENSP ID: ENSP00000306919
CVNKCTKGTKSQMNCNLGTCQLQRSGPRCLCPNTNTHWYWGETCEFNIAKSLVYGIVGAVMAVLLLALIILIILFSLSQRKRHRPESEGEQIRP

SEQ ID NO: 53123 - protein, 5478 aa, Homo sapiens
  Payload ID: 10587
  Gene Symbol: MUC12
  Gene Name: mucin 12, cell surface associated
  Uniprot ID: Q9UKN1
  ENSP ID: ENSP00000368755
MLVIWILTLALRLCASVTTVTPEGSAVHKAISQQGTLWTGEVLEKQTVEQGKSTLRRQKNHFHRSAGELRCRNALKDEGASAGWSVMFAGESVVVLVHLWMTGARVKNLGLVEFASPGDDGDGRAEGFSLGLPLSEQARAAGAREKERQETVINHSTFSGFSQITGSTVNTSIGGNTTSASTPSSSDPFTTFSDYGVSVTFITGSTATKHFLDSSTNSGHSEESTVSHSGPGATGTTLFPSHSATSVFVGEPKTSPITSASMETTALPGSTTTAGLSEKSTTFYSSPRSPDRTLSPARTTSSGVSEKSTTSHSRPGPTHTIAFPDSTTMPGVSQESTASHSIPGSTDTTLSPGTTTPSSLGPESTTFHSSPGYTKTTRLPDNTTTSGLLEASTPVHSSTGSPHTTLSPSSSTTHEGEPTTFQSWPSSKDTSPAPSGTTSAFVKLSTTYHSSPSSTPTTHFSASSTTLGHSEESTPVHSSPVATATTPPPARSATSGHVEESTAYHRSPGSTQTMHFPESSTTSGHSEESATFHGSTTHTKSSTPSTTAALAHTSYHSSLGSTETTHFRDSSTISGRSEESKASHSSPDAMATTVLPAGSTPSVLVGDSTPSPISSGSMETTALPGSTTKPGLSEKSTTFYSSPRSPDTTHLPASMTSSGVSEESTTSHSRPGSTHTTAFPGSTTMPGLSQESTASHSSPGPTDTTLSPGSTTASSLGPEYTTFHSRPGSTETTLLPDNTTASGLLEASMPVHSSTRSPHTTLSPAGSTTRQGESTTFHSWPSSKDTRPAPPTTTSAFVEPSTTSHGSPSSIPTTHISARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSERSTTFHSSPRSPATTLSPASTTSSGVSEESTTSRSRPGSTHTTAFPDSTTTPGLSRHSTTSHSSPGSTDTTLLPASTTTSGPSQESTTSHSSSGSTDTALSPGSTTALSFGQESTTFHSNPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSRGSTETTVFPHSTTTSVHGEEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSDLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPSSKDTMPAPPTTTSAFVELSTTSHGSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRTPTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTTFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTASHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSGPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGSSQESTTSHSSSGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRREEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSTGLQEESTTFQSWPSSSDTTPSPPSTTAVPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSMHTTAFPSSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESNTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSIATTHFPESSTTSGRSEESTASHSSPDTNGITPLPAHFTTSGRIAESTTFYISPGSMETTLASTATTPGLSAKSTILYSSSRSPDQTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLTEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVYGIVGAVMAVLLLALIILIILFSLSQRKRHREQYDVPQEWRKEGTPGIFQKTAIWEDQNLRESRFGLENAYNNFRPTLETVDSGTELHIQRPEMVASTV

SEQ ID NO: 53124 - protein, 5335 aa, Homo sapiens
  Payload ID: 10587
  Gene Symbol: MUC12
  Gene Name: mucin 12, cell surface associated
  Uniprot ID: Q9UKN1
  ENSP ID: ENSP00000441929
MLVIWILTLALRLCASVTTVTPGSTVNTSIGGNTTSASTPSSSDPFTTFSDYGVSVTFITGSTATKHFLDSSTNSGHSEESTVSHSGPGATGTTLFPSHSATSVFVGEPKTSPITSASMETTALPGSTTTAGLSEKSTTFYSSPRSPDRTLSPARTTSSGVSEKSTTSHSRPGPTHTIAFPDSTTMPGVSQESTASHSIPGSTDTTLSPGTTTPSSLGPESTTFHSSPGYTKTTRLPDNTTTSGLLEASTPVHSSTGSPHTTLSPSSSTTHEGEPTTFQSWPSSKDTSPAPSGTTSAFVKLSTTYHSSPSSTPTTHFSASSTTLGHSEESTPVHSSPVATATTPPPARSATSGHVEESTAYHRSPGSTQTMHFPESSTTSGHSEESATFHGSTTHTKSSTPSTTAALAHTSYHSSLGSTETTHFRDSSTISGRSEESKASHSSPDAMATTVLPAGSTPSVLVGDSTPSPISSGSMETTALPGSTTKPGLSEKSTTFYSSPRSPDTTHLPASMTSSGVSEESTTSHSRPGSTHTTAFPGSTTMPGLSQESTASHSSPGPTDTTLSPGSTTASSLGPEYTTFHSRPGSTETTLLPDNTTASGLLEASMPVHSSTRSPHTTLSPAGSTTRQGESTTFHSWPSSKDTRPAPPTTTSAFVEPSTTSHGSPSSIPTTHISARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSERSTTFHSSPRSPATTLSPASTTSSGVSEESTTSRSRPGSTHTTAFPDSTTTPGLSRHSTTSHSSPGSTDTTLLPASTTTSGPSQESTTSHSSSGSTDTALSPGSTTALSFGQESTTFHSNPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSRGSTETTVFPHSTTTSVHGEEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSDLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPSSKDTMPAPPTTTSAFVELSTTSHGSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRTPTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTTFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTASHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSGPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGSSQESTTSHSSSGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRREEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSTGLQEESTTFQSWPSSSDTTPSPPSTTAVPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSMHTTAFPSSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESNTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSIATTHFPESSTTSGRSEESTASHSSPDTNGITPLPAHFTTSGRIAESTTFYISPGSMETTLASTATTPGLSAKSTILYSSSRSPDQTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLTEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVYGIVGAVMAVLLLALIILIILFSLSQRKRHREQYDVPQEWRKEGTPGIFQKTAIWEDQNLRESRFGLENAYNNFRPTLETVDSGTELHIQRPEMVASTV

SEQ ID NO: 53125 - protein, 184 aa, Homo sapiens
  Payload ID: 10588
  Gene Symbol: MUC13
  Gene Name: mucin 13, cell surface associated
  ENSP ID: ENSP00000418660
MKAIIHLTLLALLSVNTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSS

SEQ ID NO: 53126 - protein, 512 aa, Homo sapiens
  Payload ID: 10588
  Gene Symbol: MUC13
  Gene Name: mucin 13, cell surface associated
  Uniprot ID: Q9H3R2
  ENSP ID: ENSP00000485028
MKAIIHLTLLALLSVNTATNQGNSADAVTTTETATSGPTVAAADTTETNFPETASTTANTPSFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVASSLKCPDACNAQHKQCLIKKSGGAPECACVPGYQEDANGNCQKCAFGYSGLDCKDKFQLILTIVGTIAGIVILSMIIALIVTARSNNKTKHIEEENLIDEDFQNLKLRSTGFTNLGAEGSVFPKVRITASRDSQMQNPYSRHSSMPRPDY

SEQ ID NO: 53127 - protein, 311 aa, Homo sapiens
  Payload ID: 10589
  Gene Symbol: MUC15
  Gene Name: mucin 15, cell surface associated
  ENSP ID: ENSP00000281268
MGIIQSILATSRDCYSFKKKPIPKKPTMLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKVLRLDNAPEPYDVSFGNSSYYNPTLNDSAMPESEENARDGIPMDDIPPLRTSV

SEQ ID NO: 53128 - protein, 334 aa, Homo sapiens
  Payload ID: 10589
  Gene Symbol: MUC15
  Gene Name: mucin 15, cell surface associated
  Uniprot ID: Q8N387
  ENSP ID: ENSP00000397339
MLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 53129 - protein, 361 aa, Homo sapiens
  Payload ID: 10589
  Gene Symbol: MUC15
  Gene Name: mucin 15, cell surface associated
  ENSP ID: ENSP00000416753
MGIIQSILATSRDCYSFKKKPIPKKPTMLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 53130 - protein, 311 aa, Homo sapiens; identical to SEQ ID NO: 53127
  Payload ID: 10589
  Gene Symbol: MUC15
  Gene Name: mucin 15, cell surface associated
  ENSP ID: ENSP00000431945

SEQ ID NO: 53131 - protein, 361 aa, Homo sapiens; identical to SEQ ID NO: 53129
  Payload ID: 10589
  Gene Symbol: MUC15
  Gene Name: mucin 15, cell surface associated
  ENSP ID: ENSP00000431983

SEQ ID NO: 53132 - protein, 14507 aa, Homo sapiens
  Payload ID: 10590
  Gene Symbol: MUC16
  Gene Name: mucin 16, cell surface associated
  ENSP ID: ENSP00000381008
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 53133 - protein, 1224 aa, Homo sapiens
  Payload ID: 10590
  Gene Symbol: MUC16
  Gene Name: mucin 16, cell surface associated
  ENSP ID: ENSP00000470885
  MOD_RES (1)..(1): Any amino acid
XTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDAVRRGCSTNSSETAASRVIFLTVKFQHSGLSPTGTTPGWTPCVTSRHWLGE

SEQ ID NO: 53134 - protein, 1330 aa, Homo sapiens
  Payload ID: 10590
  Gene Symbol: MUC16
  Gene Name: mucin 16, cell surface associated
  ENSP ID: ENSP00000472781
  MOD_RES (1)..(1): Any amino acid
XTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 53135 - protein, 670 aa, Homo sapiens
  Payload ID: 10590
  Gene Symbol: MUC16
  Gene Name: mucin 16, cell surface associated
  ENSP ID: ENSP00000472883
  MOD_RES (1)..(1): Any amino acid
XPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGHHTLQRQSTT

SEQ ID NO: 53136 - protein, 4493 aa, Homo sapiens
  Payload ID: 10591
  Gene Symbol: MUC17
  Gene Name: mucin 17, cell surface associated
  Uniprot ID: Q685J3
  ENSP ID: ENSP00000302716
MPRPGTMALCLLTLVLSLLPPQAAAEQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYGLVGAGVVLMLIILVALLMLVFRSKREVKRQKYRLSQLYKWQEEDSGPAPGTFQNIGFDICQDDDSIHLESIYSNFQPSLRHIDPETKIRIQRPQVMTTSF

SEQ ID NO: 53137 - protein, 4262 aa, Homo sapiens
  Payload ID: 10591
  Gene Symbol: MUC17
  Gene Name: mucin 17, cell surface associated
  ENSP ID: ENSP00000368751
MPRPGTMALCLLTLVLSLLPPQAAAEQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRHDVFQHHWHPSAKHYGDPVRP

SEQ ID NO: 53138 - protein, 1779 aa, Homo sapiens
  Payload ID: 10592
  Gene Symbol: MUC2
  Gene Name: mucin 2, oligomeric mucus/gel-forming
  ENSP ID: ENSP00000478743
MGLPLARLAAVCLALSLAGGSELQTEGRTRNHGHNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALEGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTTFTTTTTTTTPTSSTVLSTTPKLCCLWSDWINEDHPSSGSDDGDRETFDGVCGAPEDIECRSVKDPHLSLEQLGQKVQCDVSVGFICKNEDQFGNGPFGLCYDYKIRVNCCWPMDKCITTPSPPTTTPSPPPTSTTTLPPTTTPSPPTTTTTTPPPTTTPSPPITTTTTPPPTTTPSPPISTTTTPPPTTTPSPPTTTPSPPTTTPSPPTTTTTTPPPTTTPSPPTTTPITPPASTTTLPPTTTPSPPTTTTTTPPPTTTPITTTTTVTPTPTPTGTQTPTTTPITTTTTVTPTPTPTGTQTPTSTPITTTTTTPTPTAITTTTTVTPTPTPTGTQTPTTTPITTTTTVTPTPTPTGTQSPTPTAITTTTTVTPTPTPTGTQTPTSTPITTTTTVTPTPTPTGTQTPTPTPISTTTTVTPTPTPTGTQTPTTTPITTTTTVTPTPTPTGTQTPTTTPTPTSTKSTTVTPITTTTTVTATPTPTGTQTPTMIPISTTTTVTP

SEQ ID NO: 53139 - protein, 131 aa, Homo sapiens
  Payload ID: 10592
  Gene Symbol: MUC2
  Gene Name: mucin 2, oligomeric mucus/gel-forming
  ENSP ID: ENSP00000481861
FDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQC

SEQ ID NO: 53140 - protein, 2817 aa, Homo sapiens
  Payload ID: 10592
  Gene Symbol: MUC2
  Gene Name: mucin 2, oligomeric mucus/gel-forming
  ENSP ID: ENSP00000486476
MGLPLARLAAVCLALSLAGGSELQTEGRTRNHGHNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALEGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTTFTTTTTTTTPTSSTVLSTTPKLCCLWSDWINEDHPSSGSDDGDRETFDGVCGAPEDIECRSVKDPHLSLEQLGQKVQCDVSVGFICKNEDQFGNGPFGLCYDYKIRVNCCWPMDKCITTPSPPTTTPSPPPTSTTTLPPTTTPSPPTTTTTTPPPTTTPSPPITTTTTPPPTTTPSPPISTTTTPPPTTTPSPPTTTPSPPTTTPSPPTTTTTTPPPTTTPSPPTTTPITPPASTTTLPPTTTPSPPTTTTTTPPPTTTPITTTTTVTPTPTPTGTQTPTTTPITTTTTVTPTPTPTGTQTPTSTPITTTTTVTPTPTPTGTQTPTTTPITTTTTVTPTPTPTGTQTPTPTAITTTTTVTPTPTPTGTQTPTTTPITTTTTVTPTPTPTGTQSPTPTAITTTTTVTPTPTPTGTQTPTSTPITTTTTVTPTPTPTGTQTPTPTPISTTTTVTPTPTPTGTQTPTTTPITTTTTVTPTPTPTGTQTPTTVLITTTTTMTPTPTPTSTKSTTVTPITTTTTVTATPTPTGTQTPTMIPISTTTTVTPTPTPTTGSTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 53141 - protein, 538 aa, Homo sapiens
  Payload ID: 10593
  Gene Symbol: MUC20
  Gene Name: mucin 20, cell surface associated
  ENSP ID: ENSP00000325431
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 53142 - protein, 723 aa, Homo sapiens
  Payload ID: 10593
  Gene Symbol: MUC20
  Gene Name: mucin 20, cell surface associated
  ENSP ID: ENSP00000396774
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGLHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQMERSLALSPRLECSGVISAHCKLHLLGSRDSPASAS

SEQ ID NO: 53143 - protein, 128 aa, Homo sapiens
  Payload ID: 10593
  Gene Symbol: MUC20
  Gene Name: mucin 20, cell surface associated
  ENSP ID: ENSP00000397774
  MOD_RES (1)..(1): Any amino acid
XPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLMTQGTHSAHVPSMVGVNPLPIVPGGFQH

SEQ ID NO: 53144 - protein, 674 aa, Homo sapiens
  Payload ID: 10593
  Gene Symbol: MUC20
  Gene Name: mucin 20, cell surface associated
  Uniprot ID: Q8N307
  ENSP ID: ENSP00000405629
MTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGLHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 53145 - protein, 709 aa, Homo sapiens
  Payload ID: 10593
  Gene Symbol: MUC20
  Gene Name: mucin 20, cell surface associated
  Uniprot ID: Q8N307
  ENSP ID: ENSP00000414350
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGPHPVITPSRASESSASSDGLHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 53146 - protein, 503 aa, Homo sapiens
  Payload ID: 10593
  Gene Symbol: MUC20
  Gene Name: mucin 20, cell surface associated
  ENSP ID: ENSP00000478544
MTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDSSEEAKTLTMDILTLAHTSTEAKGLSSESSASSDSPHPVITPSRASESSASSDGPHPVITPSRASESSASSDGPHPVITPSWSPGSDVTLLAEALVTVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 53147 - protein, 709 aa, Homo sapiens; identical to SEQ ID NO: 53145
  Payload ID: 10593
  Gene Symbol: MUC20
  Gene Name: mucin 20, cell surface associated
  Uniprot ID: Q8N307
  ENSP ID: ENSP00000479182

SEQ ID NO: 53148 - protein, 503 aa, Homo sapiens
  Payload ID: 10593
  Gene Symbol: MUC20
  Gene Name: mucin 20, cell surface associated
  ENSP ID: ENSP00000479454
MTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 53149 - protein, 709 aa, Homo sapiens; identical to SEQ ID NO: 53145
  Payload ID: 10593
  Gene Symbol: MUC20
  Gene Name: mucin 20, cell surface associated
  Uniprot ID: Q8N307
  ENSP ID: ENSP00000479947

SEQ ID NO: 53150 - protein, 555 aa, Homo sapiens
  Payload ID: 10593
  Gene Symbol: MUC20
  Gene Name: mucin 20, cell surface associated
  ENSP ID: ENSP00000480568
MGCLWGLALPLFFFCWEVGVSGSSAGPSTRRADTAMTTDDTEVPAMTLAPGHAALETQTLSAETSSRASTPAGPVPEAETRGSKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSRASESSASSDGPHPVITPSWSPGSDVTLLAEALVTVTNIEVINCSITEIETTTSSIPGASDTDPIPTEGVKASSTSDPPALPDSTEAKPHITEVTASAETLSTAGTTESAAPDATIGTPLPTNSTIEREVTAPGATTLSGALATGNPLEETSALSVETPSYVKVSGAAPVSIEAGSAVGKTTSFAGSSASSYSPSEAALKNFTPSETLTTDIATKGPFPTSRDPLPSVPPTTTNSSRGTNSTLAKITTSAKTTMKPPTATPTTARTRPTTDMSAGENGGFLLLRLSVASPEDLTDPRVAERLMQQLHRELHAHAPHFQVSLLRVRRG

SEQ ID NO: 53151 - protein, 503 aa, Homo sapiens; identical to SEQ ID NO: 53146
  Payload ID: 10593
  Gene Symbol: MUC20
  Gene Name: mucin 20, cell surface associated
  ENSP ID: ENSP00000480845

SEQ ID NO: 53152 - protein, 503 aa, Homo sapiens; identical to SEQ ID NO: 53148
  Payload ID: 10593
  Gene Symbol: MUC20
  Gene Name: mucin 20, cell surface associated
  ENSP ID: ENSP00000482294

SEQ ID NO: 53153 - protein, 709 aa, Homo sapiens; identical to SEQ ID NO: 53145
  Payload ID: 10593
  Gene Symbol: MUC20
  Gene Name: mucin 20, cell surface associated
  Uniprot ID: Q8N307
  ENSP ID: ENSP00000483878

SEQ ID NO: 53154 - protein, 503 aa, Homo sapiens; identical to SEQ ID NO: 53146
  Payload ID: 10593
  Gene Symbol: MUC20
  Gene Name: mucin 20, cell surface associated
  ENSP ID: ENSP00000484531

SEQ ID NO: 53155 - protein, 128 aa, Homo sapiens
  Payload ID: 10593
  Gene Symbol: MUC20
  Gene Name: mucin 20, cell surface associated
  ENSP ID: ENSP00000485702
  MOD_RES (1)..(1): Any amino acid
XPTMDIATKGPFPTSRDPLPSVPPTTTNSSRGTNSTLAKITTSAKTTMKPPTATPTTARTRPTTDVSAGENGGFLLLWLSVASPEDLTDPRVAERLMQQLMTQGTHSAHVPSMVGVNPLPIVPGGFQH

SEQ ID NO: 53156 - protein, 127 aa, Homo sapiens
  Payload ID: 10593
  Gene Symbol: MUC20
  Gene Name: mucin 20, cell surface associated
  ENSP ID: ENSP00000485806
  MOD_RES (1)..(1): Any amino acid
XTTDIATKGPFPTSRDPLPSVPPTTTNSSRGTNSTLAKITTSAKTTMKPPTATPTTARTRPTTDMSAGENGGFLLLRLSVASPEDLTDPRVAERLMQQLMTQGTHSAHVPSMVGVNPLPIVPGGFQY

SEQ ID NO: 53157 - protein, 674 aa, Homo sapiens; identical to SEQ ID NO: 53144
  Payload ID: 10593
  Gene Symbol: MUC20
  Gene Name: mucin 20, cell surface associated
  Uniprot ID: Q8N307
  ENSP ID: ENSP00000485837

SEQ ID NO: 53158 - protein, 674 aa, Homo sapiens; identical to SEQ ID NO: 53144
  Payload ID: 10593
  Gene Symbol: MUC20
  Gene Name: mucin 20, cell surface associated
  Uniprot ID: Q8N307
  ENSP ID: ENSP00000485855

SEQ ID NO: 53159 - protein, 128 aa, Homo sapiens; identical to SEQ ID NO: 53143
  Payload ID: 10593
  Gene Symbol: MUC20
  Gene Name: mucin 20, cell surface associated
  ENSP ID: ENSP00000485873
  MOD_RES (1)..(1): Any amino acid

SEQ ID NO: 53160 - protein, 674 aa, Homo sapiens; identical to SEQ ID NO: 53144
  Payload ID: 10593
  Gene Symbol: MUC20
  Gene Name: mucin 20, cell surface associated
  Uniprot ID: Q8N307
  ENSP ID: ENSP00000485921

SEQ ID NO: 53161 - protein, 723 aa, Homo sapiens; identical to SEQ ID NO: 53142
  Payload ID: 10593
  Gene Symbol: MUC20
  Gene Name: mucin 20, cell surface associated
  ENSP ID: ENSP00000486236

SEQ ID NO: 53162 - protein, 535 aa, Homo sapiens
  Payload ID: 10593
  Gene Symbol: MUC20
  Gene Name: mucin 20, cell surface associated
  ENSP ID: ENSP00000486394
MGCLWGLALPLFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDISEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLWLSVASPEDLTDPRVAERLMQQLHRELHAHAPHFQVSLLRVRRG

SEQ ID NO: 53163 - protein, 723 aa, Homo sapiens; identical to SEQ ID NO: 53142
  Payload ID: 10593
  Gene Symbol: MUC20
  Gene Name: mucin 20, cell surface associated
  ENSP ID: ENSP00000486409

SEQ ID NO: 53164 - protein, 128 aa, Homo sapiens; identical to SEQ ID NO: 53143
  Payload ID: 10593
  Gene Symbol: MUC20
  Gene Name: mucin 20, cell surface associated
  ENSP ID: ENSP00000486488
  MOD_RES (1)..(1): Any amino acid

SEQ ID NO: 53165 - protein, 520 aa, Homo sapiens
  Payload ID: 10593
  Gene Symbol: MUC20
  Gene Name: mucin 20, cell surface associated
  ENSP ID: ENSP00000486526
MTTDDTEVPAMTLAPGHAALETQTLSAETSSRASTPAGPVPEAETRGSKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSRASESSASSDGPHPVITPSWSPGSDVTLLAEALVTVTNIEVINCSITEIETTTSSIPGASDTDPIPTEGVKASSTSDPPALPDSTEAKPHITEVTASAETLSTAGTTESAAPDATIGTPLPTNSTIEREVTAPGATTLSGALATGNPLEETSALSVETPSYVKVSGAAPVSIEAGSAVGKTTSFAGSSASSYSPSEAALKNFTPSETLTTDIATKGPFPTSRDPLPSVPPTTTNSSRGTNSTLAKITTSAKTTMKPPTATPTTARTRPTTDMSAGENGGFLLLRLSVASPEDLTDPRVAERLMQQLHRELHAHAPHFQVSLLRVRRG

SEQ ID NO: 53166 - protein, 128 aa, Homo sapiens; identical to SEQ ID NO: 53143
  Payload ID: 10593
  Gene Symbol: MUC20
  Gene Name: mucin 20, cell surface associated
  ENSP ID: ENSP00000486549
  MOD_RES (1)..(1): Any amino acid

SEQ ID NO: 53167 - protein, 128 aa, Homo sapiens; identical to SEQ ID NO: 53143
  Payload ID: 10593
  Gene Symbol: MUC20
  Gene Name: mucin 20, cell surface associated
  ENSP ID: ENSP00000486753
  MOD_RES (1)..(1): Any amino acid

SEQ ID NO: 53168 - protein, 128 aa, Homo sapiens; identical to SEQ ID NO: 53143
  Payload ID: 10593
  Gene Symbol: MUC20
  Gene Name: mucin 20, cell surface associated
  ENSP ID: ENSP00000486769
  MOD_RES (1)..(1): Any amino acid

SEQ ID NO: 53169 - protein, 552 aa, Homo sapiens
  Payload ID: 10593
  Gene Symbol: MUC20
  Gene Name: mucin 20, cell surface associated
  ENSP ID: ENSP00000486805
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQMERSLALSPRLECSGVISAHCKLHLLGSRDSPASAS

SEQ ID NO: 53170 - protein, 549 aa, Homo sapiens
  Payload ID: 10593
  Gene Symbol: MUC20
  Gene Name: mucin 20, cell surface associated
  ENSP ID: ENSP00000486905
MGCLWGLALPLFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDISEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLWLSVASPEDLTDPRVAERLMQQMERSLALSPRLECSGVISAHCKLHLLGSRDSPASAS

SEQ ID NO: 53171 - protein, 552 aa, Homo sapiens; identical to SEQ ID NO: 53169
  Payload ID: 10593
  Gene Symbol: MUC20
  Gene Name: mucin 20, cell surface associated
  ENSP ID: ENSP00000487039

SEQ ID NO: 53172 - protein, 569 aa, Homo sapiens
  Payload ID: 10593
  Gene Symbol: MUC20
  Gene Name: mucin 20, cell surface associated
  ENSP ID: ENSP00000487047
MGCLWGLALPLFFFCWEVGVSGSSAGPSTRRADTAMTTDDTEVPAMTLAPGHAALETQTLSAETSSRASTPAGPVPEAETRGSKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSRASESSASSDGPHPVITPSWSPGSDVTLLAEALVTVTNIEVINCSITEIETTTSSIPGASDTDPIPTEGVKASSTSDPPALPDSTEAKPHITEVTASAETLSTAGTTESAAPDATIGTPLPTNSTIEREVTAPGATTLSGALATGNPLEETSALSVETPSYVKVSGAAPVSIEAGSAVGKTTSFAGSSASSYSPSEAALKNFTPSETLTTDIATKGPFPTSRDPLPSVPPTTTNSSRGTNSTLAKITTSAKTTMKPPTATPTTARTRPTTDMSAGENGGFLLLRLSVASPEDLTDPRVAERLMQQMERSLALSPRLECSGVISAHCKLHLLGSRDSPASAS

SEQ ID NO: 53173 - protein, 538 aa, Homo sapiens
  Payload ID: 10593
  Gene Symbol: MUC20
  Gene Name: mucin 20, cell surface associated
  ENSP ID: ENSP00000487209
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDSSEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITEIETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 53174 - protein, 723 aa, Homo sapiens; identical to SEQ ID NO: 53142
  Payload ID: 10593
  Gene Symbol: MUC20
  Gene Name: mucin 20, cell surface associated
  ENSP ID: ENSP00000487262

SEQ ID NO: 53175 - protein, 501 aa, Homo sapiens
  Payload ID: 10593
  Gene Symbol: MUC20
  Gene Name: mucin 20, cell surface associated
  ENSP ID: ENSP00000487482
MTTDDTEVPAMTLAPGHAALETQTLSAETSSRASTPAGPIPEAETRGAKRISPARETRSFTKTSPNFMVLIATSVETSAASGSPEGAGMTTVQTITGSDPEEAIFDTLCTDDISEEAKTLTMDILTLAHTSTEAKGLSSESSASSDGPHPVITPSRASESSASSDGPHPVITPSRASESSASSDGPHPVITPSWSPGSDVTLLAEALVTVTNIEVINCSITETTTSSIPGASDIDLIPTEGVKASSTSDPPALPDSTEAKPHITEVTASAETLSTAGTTESAAPHATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLWLSVASPEDLTDPRVAERLMQQLHRELHAHAPHFQVSLLRVRRG

SEQ ID NO: 53176 - protein, 538 aa, Homo sapiens; identical to SEQ ID NO: 53173
  Payload ID: 10593
  Gene Symbol: MUC20
  Gene Name: mucin 20, cell surface associated
  ENSP ID: ENSP00000487573

SEQ ID NO: 53177 - protein, 566 aa, Homo sapiens
  Payload ID: 10594
  Gene Symbol: MUC21
  Gene Name: mucin 21, cell surface associated
  Uniprot ID: Q5SSG8
  ENSP ID: ENSP00000365473
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 53178 - protein, 626 aa, Homo sapiens
  Payload ID: 10594
  Gene Symbol: MUC21
  Gene Name: mucin 21, cell surface associated
  ENSP ID: ENSP00000373027
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTVTNSGSSVTSSGASTATNSESSTVSSRASTATNSESSTLSSGASTATNSDSSTTSSGASTATNSESSTTSSGASTATNSESSTVSSRASTATNSESSTTSSGASTATNSESRTTSNGAGTATNSESSTTSSGASTATNSDSSTVSSGASTATNSESSTTSSGASTATNSDSSTTSSGAGTATNSESSTTSSGASTATNSESSTTSSGASTATNSDSSTTSSGAGTATNSESSTVSSGISTVTNSESSTPSSGANTATNSESSTTSSGANTATNSESSTVSSGASTATNSESSTTSSGVSTATNSESSTTSSGASTATNSDSSTTSSEASTATNSESSTVSSGISTVTNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 53179 - protein, 566 aa, Homo sapiens
  Payload ID: 10594
  Gene Symbol: MUC21
  Gene Name: mucin 21, cell surface associated
  ENSP ID: ENSP00000393390
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 53180 - protein, 566 aa, Homo sapiens; identical to SEQ ID NO: 53179
  Payload ID: 10594
  Gene Symbol: MUC21
  Gene Name: mucin 21, cell surface associated
  ENSP ID: ENSP00000401817

SEQ ID NO: 53181 - protein, 566 aa, Homo sapiens
  Payload ID: 10594
  Gene Symbol: MUC21
  Gene Name: mucin 21, cell surface associated
  ENSP ID: ENSP00000407508
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTVTNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 53182 - protein, 566 aa, Homo sapiens; identical to SEQ ID NO: 53179
  Payload ID: 10594
  Gene Symbol: MUC21
  Gene Name: mucin 21, cell surface associated
  ENSP ID: ENSP00000414676

SEQ ID NO: 53183 - protein, 596 aa, Homo sapiens
  Payload ID: 10594
  Gene Symbol: MUC21
  Gene Name: mucin 21, cell surface associated
  ENSP ID: ENSP00000416075
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTVTNSGSSVTSSGASTATNSESSTVSSRASTATNSESSTLSSGASTATNSDSSTTSSGASTATNSESSTTSSGASTATNSESSTVSSRASTATNSESSTTSSGASTATNSESRTTSNGAGTATNSESSTTSSGASTATNSDSSTVSSGASTATNSESSTTSSGASTATNSESSTTSSGASTATNSDSSTTSSGAGTATNSESSTVSSGISTVTNSESSTPSSGANTATNSESSTTSSGANTATNSESSTVSSGASTATNSESSTTSSGVSTATNSESSTTSSGASTATNSDSSTTSSEASTATNSESSTVSSGISTVTNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 53184 - protein, 566 aa, Homo sapiens
  Payload ID: 10594
  Gene Symbol: MUC21
  Gene Name: mucin 21, cell surface associated
  ENSP ID: ENSP00000447201
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTATNSESSTLSSGASTATNSDSSTTSSGASTATNSESSTTSSGASTATNSESSTVSSRASTATNSESSTTSSGASTATNSESRTTSNGAGTATNSESSTTSSGASTATNSDSSTTSSGAGTATNSESSTTSSGASTATNSESSTTSSGASTATNSDSSTTSSGAGTATNSESSTVSSGISTVTNSESSTPSSGANTATNSESSTTSSGANTATNSESSTVSSGASTATNSESSTTSSGVSTATNSESSTTSSGASTATNSDSSTTSSEASTATNSESSTVSSGISTVTNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 53185 - protein, 416 aa, Homo sapiens
  Payload ID: 10594
  Gene Symbol: MUC21
  Gene Name: mucin 21, cell surface associated
  ENSP ID: ENSP00000447840
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 53186 - protein, 416 aa, Homo sapiens
  Payload ID: 10594
  Gene Symbol: MUC21
  Gene Name: mucin 21, cell surface associated
  ENSP ID: ENSP00000448890
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTATNSDSSTTSSGASTATNSESSTTSSGASTATNSESSTTSSGASTATNSESSTTSSGANTATNSESSTVSSGASTATNSESSTTSSGVSTATNSESSTTSSGASTATNSDSSTTSSEASTATNSESSTVSSGISTVTNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 53187 - protein, 112 aa, Homo sapiens
  Payload ID: 10594
  Gene Symbol: MUC21
  Gene Name: mucin 21, cell surface associated
  ENSP ID: ENSP00000457640
MHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 53188 - protein, 418 aa, Homo sapiens
  Payload ID: 10594
  Gene Symbol: MUC21
  Gene Name: mucin 21, cell surface associated
  ENSP ID: ENSP00000478961
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTATNSDSSTTSSGASTATNSESSTTSSGASTATNSESSTTSSGAGTATNSESSTTSSGASTATNSESSTTTVSSGASTATNSESSTTSSGVSTATNSESSTTSSGASTATNSDSSTTSSEASTATNSESSTVSSGISTVTNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 53189 - protein, 1773 aa, Homo sapiens
  Payload ID: 10595
  Gene Symbol: MUC22
  Gene Name: mucin 22
  Uniprot ID: E2RYF6
  ENSP ID: ENSP00000455906
MRRGNISPAFWFLWLLLFGLLGPSSENTTAFTKGSDTTTASITGSETTMASTMASTSALTTGSKITTDSTTGSETTSASTMASTAAFTTGSETNTASTTDSGTTIASTRTFTTGSDTTTGSTAGSETIVASTTVSGTTTTFTIASTTVPETTMASSTTSTAGSEKTMASSIISETTMASTTGSETATVSTTGSETTTTSTASSEATKVSTTGSETTTASTAGSETTTTSTSMAGSEATTTSTADSKVITASSMSSETTVAPAAGSNTTTASTTGSETTTILIKASETTTASTAGSETTTPSPTGSQTTIVSISGSEITTTSTAGSENTTVSSAGSGTTTASMAGSETTVSTAGSETTTVSITGTETTMVSAMGSETTTNSTTSSETTVTSTAGSETTTVSTVGSETTTAYTADSETTAASTTGSEMTTVFTAGSETITPSTAGSETTTVSTAGSETTTVSTTGSETTTASTAHSETTAASTMGSETTKVSTAGSETTVSTAGSETTAASTEDSETNTAFTEDSKTTTASTTGFETTAASTTGSEPTMASTMGSETTMASTIGPETTKVSTASSEVTTVFAAGSETIRASTVGSETTTVSTTGSETTTASIMGSETSTDSTTGSETTTASTEGSETTTASTEGSEATTVSTTGSETTTVSITDSETTTTCTEGSEMTAVSTTVFETTTASTEGSEITIASTSDSETTTASTEGSETTTVTTAGSETKTAYTTGSETTTASNTGLETTTVFTIGSDTTTASTEGSETTAVSATGSEMTTVSTEGSENTTVSTTGSETTTVSTTGLETTTTSTEGSEMTTVSTTGAETTTDSTEGSGTTAASTAGSETTTVSTADSENTTASTADSETTSASTTGSETTTASTTSSETTTASTEGSETTTVSTTDSETTMVSTTGSERTITSTEGSETTTVSATGSETTVSTEGSGTTTVSITGSETTKVSTTGSETTTTSTEGSEITTASITGSETTTASTEGSETTTASTEGSETTSASTTGSETTTASTTSSETTMASIMGSETTMASTIGSETTKVSTASSKMTTVFTENSETTIASTTASETTTVSTAGSETIPASTAGSETTTTTSTEGSETTTASTEGSETTTASTESSETTTATTIGSETTTASTEGSETTTTSTEGSETTTASTEGSEITTVSTTGSETTTASTEGSETTTASTEGSELTTVSTTGSETITVSAEGSETTTVTTMGSETTTASTAGSETTTVSTAGSETTTASIEGSETTTVSSTGSETTTVSTTGTETTITSTEGSETTTVTTAGSETTAVYTTGSETTTTSTEGSETTTVSTTGSETTTASTADLETTTVSTSGSGTTTASTAGSETTTVYITGSKTTTASTEGSEATTVSTTSSETTTASTTGSEMTTVFTTVSETTTVSTIGSEATTSSAAGSEATTTSTEGSETTTASTAGSETTTASTAGSETTTASTSGSETNTACTTGSETSTPSSAGSETNTAFIIGSESTIASTASLEPTATSLTGSETTTVSITASGATAASTTVSSTTFVLTKATDVSIQPITNTPMSGTRTTGTRLTASSSVTMAPGMDFTASAASHTVPGIVLNTSGLGTSTMGASSTTSAHGVRTTTGSTREPTSSTFQETGPVSMGTNTVSMSHTPTNVIKPSGYLQPWAIILISLAAVVAAVGLSVGLSFCLRNLFFPLRYCGIYYPHGHSHSLGLDLNLGLGSGTFHSLGNALVHGGELEMGHGGTHGFGYGVGHGLSHIHGDGYGVNHGGHYGHGGGH

SEQ ID NO: 53190 - protein, 3323 aa, Homo sapiens
  Payload ID: 10596
  Gene Symbol: MUC3A
  Gene Name: mucin 3A, cell surface associated
  ENSP ID: ENSP00000368771
MQLLGLLGLLWMLKASPWATGTLSTATSISQVPFPRAEAASAVLSNSPHSRDLAGWPLGVPQLASPAPGHRENAPMTLTTSPHDTLISETLLNSPVSSNTSTTPTSKFAFKVETTPPTVLVYSATTECVYPTSFIITISHPTSICVTTTQVAFTSSYTSTPVTQKPVTTVTSTYSMTTTEKGTSAMTSSPSTTTARETPIVTVTPSSVSATDTTFHTTISSTTRTTERTPLPTGSIHTTTSPTPVFTTLKTAVTSTSPITSSITSTNTVTSMTTTASQPTATNTLSSPTRTILSSTPVLSTETITSGITNTTPLSTLVTTLPTTISRSTPTSETTYTTSPTSTVTDSTTKIAYSTSMTGTLSTETSLPPTSSSLPTTETATTPMTNLVTTTTEISSHSTPSFSSSTIYSTVSTSTTAISSLPPTSGTMVTSTTMTPSSLSTDIPFTTPTTITHHSVGSTGFLTTATDLTSTFTVSSSSAMSTSVIPSSPSIQNTETSSLVSMTSATTPNVRPTFVSTLSTPTSSLLTTFPATYSFSSSMSASSAGTTHTESISSPPASTSTLHTTAESTLAPTTTTSFTTSTTMEPPSTTAATTGTGQTTFTSSTATFPETTTPTPTTDMSTESLTTAMTSPPITSSVTSTNTVTSMTTTTSPPTTTNSFTSLTSMPLSSTPVPSTEVVTSGTINTIPPSILVTTLPTPNASSMTTSETTYPNSPTGPGTNSTTEITYPTTMTETSSTATSLPPTSPLVSTAKTAKTPTTNLVTTTTKTTSHSTTSFTSSTVYSTASTYTTAITSVPTTLGTMVTSTSMISSTVSTGIPTSQPTTITPSSVGISGSLPMMTDLTSVYTVSNMSARPTTVIPSSPTVQNTEISISVSMTSATTPSGGPTFTSTENTPTRSLLTSFPMTHSFSSSMSESSAGTTHTESISSPRGTTSTLHTTVESTPSPTTTTSFTTSTMMEPPSSTVSTTGRGQTTFPSSTATFPETTTLTPTTDISTVSLTTAMTSPPPVSSSITPTNTMTSMRTTTYWPTATNTLSPLTSSILSSTPVPSTEMITSHTTNTTPLSTLVTTLLTTITRSTPTSETTYPTSPTSIVSDSTTEITYSTSITGTLSTATTLPPTSSSLPTTETATMTPTTTLITTTPNTTSLSTPSFTSSTIYSTVSTSTTAISSASPTSGTMVTSTTMTPSSLSTDTPSTTPTTITYPSVGSTGFLTTATDLTSTFTVSSSSAMSTSVIPSSPSIQNTETSSLVSMTSATTPSLRPTITSTDSTLTSSLLTTFPSTYSFSSSMSASSAGTTHTETISSLPASTNTIHTTAESALAPTTTTSFTTSPTMEPPSTTVATTGTGQTTFPSSTATFLETTTLTPTTDFSTESLTTAMTSTPPITSSITPTDTMTSMRTTTSWPTATNTLSPLTSSILSSTPVPSTEVTTSHTTNTNPVSTLVTTLPITITRSTLTSETAYPSSPTSTVTESTTEITYPTTMTETSSTATSLPPTSSLVSTAETAKTPTTNLVTTTTKTTSHSTTSFTSSTIYSTASTPTTAITSVPTTLGTMVTSTSMIPSTVSTGIPTSQPTTITPSSVGISGSLPMMTDLTSVYTVSSMSARPTSVIPSSPTVQNTETSIFVSMMSATTPSGGPTFTSTENTPTRSLLTSFPVTHSFSSSMSASSVGTTHTQSISSPPAITSTLHTTAESTPSPTTTMSFTTFTKMETPSSTVATTGTGQTTFTSSTATSPKTTTLTPTSDISTGSFKTAVSSTPPITSSITSTYTVTSMTTTTPLGPTATNTLPSFTSSVSSSTPVPSTEAITSGTTNTTPLSTLVTTFSNSDTSSTPTSETTYPTSLTSALTDSTTRTTYSTNMTGTLSTVTSLRPTSSSLLTTVTATVPTTNLVTTTTKITSHSTPSFTSSIATTETPSHSTPRFTSSITTTETPSHSTPRFTSSITNTKTTSHSSPSFTSSITTTETTSHNTPSLTSSITTTKTTSHSTPSYTSLITTTTTTSHSTPSFTSSITTTETTSHNTPSLTSSITTTETTSHSTPSFTSSITTETTSHSTPSFTSLITITEITSHSTLSYTTSITTTETPSHSTLSFTSSITTTETTSHSTPSFTSSITTSEMPSHSTPSFTSSITTTENATHSTPNFTSSITTTETTSHSTPSFTSLITTTETTSHRWGTTETTSYSTPSFTSSNTITETTSHSTPSYITSITTTETPSSSTPSFSSSITTTETTSHSTPGFTSSITTTETTSHSTPSFTSSITTTETTSHDTPSFTSSITTSETPSHSTPSSTSLITTTKTTSHSTPSFTSSITTTETTSHSAHSFTSSITTTETTSHNTRSFTSSITTTETNSHSTTSFTSSITTTETTSHSTPSFSSSITTTETPLHSTPGLTSWVTTTKTTSHITPGLTSSITTTETTSHSTPGFTSSITTTETTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 53191 - protein, 1002 aa, Homo sapiens
  Payload ID: 10596
  Gene Symbol: MUC3A
  Gene Name: mucin 3A, cell surface associated
  Uniprot ID: Q02505
  ENSP ID: ENSP00000393306
  MOD_RES (1)..(1): Any amino acid
XITITEITSHSTLSYTTSITTTETPSHSTLSFTSSITTTETTSHSTPSFTSSITTSEMPSHSTPSFTSSITTTENATHSTPNFTSSITTTETTSHSTPSFTSLITTTETTSHRWGTTETTSYSTPSFTSSNTITETTSHSTPSYITSITTTETPSSSTPSFSSSITTTETTSHSTPGFTSSITTTETTSHSTPSFTSSITTTETTSHDTPSFTSSITTSETPSHSTPSSTSLITTTKTTSHSTPSFTSSITTTETTSHSAHSFTSSITTTETTSHNTRSFTSSITTTETNSHSTTSFTSSITTTETTSHSTPSFSSSITTTETPLHSTPGLTSWVTTTKTTSHITPGLTSSITTTETTSHSTPGFTSSITTTETTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDAEDFCRHAGLHLQGCGDPVPEEWQHRGGLPGPAGDALQPPAGERV

SEQ ID NO: 53192 - protein, 3265 aa, Homo sapiens
  Payload ID: 10596
  Gene Symbol: MUC3A
  Gene Name: mucin 3A, cell surface associated
  ENSP ID: ENSP00000483541
MQLLGLLGLLWMLKASPWATGTLSTATSISQVPFPRAEAASAVLSNSPHSRDLAGWPLGVPQLASPAPGHRENAPMTLTTSPHDTLISETLLNSPVSSNTSTTPTSKFAFKVETTPPTVLVYSATTECVYPTSFIITISHPTSICVTTTQVAFTSSYTSTPVTQKPVTTVTSTYSMTTTEKGTSAMTSSPSTTTARETPIVTVTPSSVSATDTTFHTTISSTTRTTERTPLPTGSIHTTTSPTPVFTTLKTAVTSTSPITSSITSTNTVTSMTTTASQPTATNTLSSPTRTILSSTPVLSTETITSGITNTTPLSTLVTTLPTTISRSTPTSETTYTTSPTSTVTDSTTKIAYSTSMTGTLSTETSLPPTSSSLPTTETATTPMTNLVTTTTEISSHSTPSFSSSTIYSTVSTSTTAISSLPPTSGTMVTSTTMTPSSLSTDIPFTTPTTITHHSVGSTGFLTTATDLTSTFTVSSSSAMSTSVIPSSPSIQNTETSSLVSMTSATTPNVRPTFVSTLSTPTSSLLTTFPATYSFSSSMSASSAGTTHTESISSPPASTSTLHTTAESTLAPTTTTSFTTSTTMEPPSTTAATTGTGQTTFTSSTATFPETTTPTPTTDMSTESLTTAMTSPPITSSVTSTNTVTSMTTTTSPPTTTNSFTSLTSMPLSSTPVPSTEVVTSGTINTIPPSILVTTLPTPNASSMTTSETTYPNSPTGPGTNSTTEITYPTTMTETSSTATSLPPTSPLVSTAKTAKTPTTNLVTTTTKTTSHSTTSFTSSTVYSTASTYTTAITSVPTTLGTMVTSTSMISSTVSTGIPTSQPTTITPSSVGISGSLPMMTDLTSVYTVSNMSARPTTVIPSSPTVQNTEISISVSMTSATTPSGGPTFTSTENTPTRSLLTSFPMTHSFSSSMSESSAGTTHTESISSPRGTTSTLHTTVESTPSPTTTTSFTTSTMMEPPSSTVSTTGRGQTTFPSSTATFPETTTLTPTTDISTVSLTTAMTSPPPVSSSITPTNTMTSMRTTTYWPTATNTLSPLTSSILSSTPVPSTEMITSHTTNTTPLSTLVTTLLTTITRSTPTSETTYPTSPTSIVSDSTTEITYSTSITGTLSTATTLPPTSSSLPTTETATMTPTTTLITTTPNTTSLSTPSFTSSTIYSTVSTSTTAISSASPTSGTMVTSTTMTPSSLSTDTPSTTPTTITYPSVGSTGFLTTATDLTSTFTVSSSSAMSTSVIPSSPSIQNTETSSLVSMTSATTPSLRPTITSTDSTLTSSLLTTFPSTYSFSSSMSASSAGTTHTETISSLPASTNTIHTTAESALAPTTTTSFTTSPTMEPPSTTVATTGTGQTTFPSSTATFLETTTLTPTTDFSTESLTTAMTSTPPITSSITPTDTMTSMRTTTSWPTATNTLSPLTSSILSSTPVPSTEVTTSHTTNTNPVSTLVTTLPITITRSTLTSETAYPSSPTSTVTESTTEITYPTTMTETSSTATSLPPTSSLVSTAETAKTPTTNLVTTTTKTTSHSTTSFTSSTIYSTASTPTTAITSVPTTLGTMVTSTSMIPSTVSTGIPTSQPTTITPSSVGISGSLPMMTDLTSVYTVSSMSARPTSVIPSSPTVQNTETSIFVSMMSATTPSGGPTFTSTENTPTRSLLTSFPVTHSFSSSMSASSVGTTHTQSISSPPAITSTLHTTAESTPSPTTTMSFTTFTKMETPSSTVATTGTGQTTFTSSTATSPKTTTLTPTSDISTGSFKTAVSSTPPITSSITSTYTVTSMTTTTPLGPTATNTLPSFTSSVSSSTPVPSTEAITSGTTNTTPLSTLVTTFSNSDTSSTPTSETTYPTSLTSALTDSTTRTTYSTNMTGTLSTVTSLRPTSSSLLTTVTATVPTTNLVTTTTKITSHSTPSFTSSIATTETPSHSTPRFTSSITTTETPSHSTPRFTSSITNTKTTSHSSPSFTSSITTTETTSHNTPSLTSSITTTKTTSHSTPSYTSLITTTTTTSHSTPSFTSSITTTETTSHNTPSLTSSITTTETTSHSTPSFTSSITTETTSHSTPSFTSLITITEITSHSTLSYTTSITTTETPSHSTLSFTSSITTTETTSHSTPSFTSSITTSEMPSHSTPSFTSSITTTENATHSTPNFTSSITTTETTSHSTPSFTSLITTTETTSHRWGTTETTSYSTPSFTSSNTITETTSHSTPSYITSITTTETPSSSTPSFSSSITTTETTSHSTPGFTSSITTTETTSHSTPSFTSSITTTETTSHDTPSFTSSITTSETPSHSTPSSTSLITTTKTTSHSTPSFTSSITTTETTSHSAHSFTSSITTTETTSHNTRSFTSSITTTETNSHSTTSFTSSITTTETTSHSTPSFSSSITTTETPLHSTPGLTSWVTTTKTTSHITPGLTSSITTTETTSHSTPGFTSSITTTETTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRSWDQDRKWFETWDEEVVGTFSNWGFEDDGTDKDTNFYVALENVDTTMKVHIKRPEMTSSSV

SEQ ID NO: 53193 - protein, 1176 aa, Homo sapiens
  Payload ID: 10597
  Gene Symbol: MUC4
  Gene Name: mucin 4, cell surface associated
  Uniprot ID: Q99102
  ENSP ID: ENSP00000304207
MKGARWRRVPWVSLSCLCLCLLPHVVPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53194 - protein, 174 aa, Homo sapiens
  Payload ID: 10597
  Gene Symbol: MUC4
  Gene Name: mucin 4, cell surface associated
  ENSP ID: ENSP00000310528
  MOD_RES (1)..(1): Any amino acid
XLKMETPGMTTPSLKTDGGRRTATSPPPTTSQTIISTIPSTAMHTRSTAAPIPILPERGEAIQEFPSSPMGQAPGTWSSSGGPWTSPPHSSSRRLASPLAPLSVIPSTSQTMARSSSQSQTTRFSPTPTHSQQASQAGTLWPWWLRSGTMLTSPLVGGPHFIRNTRRSMVNTAC

SEQ ID NO: 53195 - protein, 1125 aa, Homo sapiens
  Payload ID: 10597
  Gene Symbol: MUC4
  Gene Name: mucin 4, cell surface associated
  Uniprot ID: Q99102
  ENSP ID: ENSP00000338109
MKGARWRRVPWVSLSCLCLCLLPHVVPGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53196 - protein, 144 aa, Homo sapiens
  Payload ID: 10597
  Gene Symbol: MUC4
  Gene Name: mucin 4, cell surface associated
  ENSP ID: ENSP00000345378
  MOD_RES (1)..(1): Any amino acid
XLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYASQAGTLWPWWLRSGTMLTSPLVGGPHFIRNTRRSMVNTAC

SEQ ID NO: 53197 - protein, 144 aa, Homo sapiens; identical to SEQ ID NO: 53196
  Payload ID: 10597
  Gene Symbol: MUC4
  Gene Name: mucin 4, cell surface associated
  ENSP ID: ENSP00000376208
  MOD_RES (1)..(1): Any amino acid

SEQ ID NO: 53198 - protein, 164 aa, Homo sapiens
  Payload ID: 10597
  Gene Symbol: MUC4
  Gene Name: mucin 4, cell surface associated
  ENSP ID: ENSP00000389780
  MOD_RES (1)..(1): Any amino acid
XLKMETPGMTTPSLKTDGGRRTATSPPPTTSQTIISTIPSTAMHTRSTAAPIPILPERGEAIQEFPSSPMGQAPGTWSSSGGPWTSPPHSSSRRLASPLAPLSVIPSTSQTMARSSSQSQTTRFSPTPTHSQQASQAGTLWPWWLRSGTMLTSPLVGGPHFIRL

SEQ ID NO: 53199 - protein, 144 aa, Homo sapiens; identical to SEQ ID NO: 53196
  Payload ID: 10597
  Gene Symbol: MUC4
  Gene Name: mucin 4, cell surface associated
  ENSP ID: ENSP00000407750
  MOD_RES (1)..(1): Any amino acid

SEQ ID NO: 53200 - protein, 4442 aa, Homo sapiens
  Payload ID: 10597
  Gene Symbol: MUC4
  Gene Name: mucin 4, cell surface associated
  ENSP ID: ENSP00000417397
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYASQAGTLWPWWLRSGTMLTSPLVGGPHFIRATPTKPSSPRTGAGPMPCFSTRAVGCSGTWPSAQATRCSWASLVEMAISKTAH

SEQ ID NO: 53201 - protein, 5412 aa, Homo sapiens
  Payload ID: 10597
  Gene Symbol: MUC4
  Gene Name: mucin 4, cell surface associated
  ENSP ID: ENSP00000417498
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53202 - protein, 4458 aa, Homo sapiens
  Payload ID: 10597
  Gene Symbol: MUC4
  Gene Name: mucin 4, cell surface associated
  ENSP ID: ENSP00000417657
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQSNTYQAILSTDGSRSYALFLYQSGGMQWDVAQRSVEMAISKTAH

SEQ ID NO: 53203 - protein, 4430 aa, Homo sapiens
  Payload ID: 10597
  Gene Symbol: MUC4
  Gene Name: mucin 4, cell surface associated
  ENSP ID: ENSP00000417722
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGEAIQEFPSSPMGQAPGTWSSSGGPWTSPPHSSSRRLASPLAPLSVIPSTSQTMARSSSQSQTTRFSPTPTHSQQASQAGTLWPWWLRSGTMLTSPLVGGPHFIRNTRRSMVNTAC

SEQ ID NO: 53204 - protein, 4430 aa, Homo sapiens; identical to SEQ ID NO: 53203
  Payload ID: 10597
  Gene Symbol: MUC4
  Gene Name: mucin 4, cell surface associated
  ENSP ID: ENSP00000417757

SEQ ID NO: 53205 - protein, 4510 aa, Homo sapiens
  Payload ID: 10597
  Gene Symbol: MUC4
  Gene Name: mucin 4, cell surface associated
  ENSP ID: ENSP00000418306
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSVEMAISKTAH

SEQ ID NO: 53206 - protein, 5070 aa, Homo sapiens
  Payload ID: 10597
  Gene Symbol: MUC4
  Gene Name: mucin 4, cell surface associated
  ENSP ID: ENSP00000419798
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLELWGALSCVRTSPAL

SEQ ID NO: 53207 - protein, 4400 aa, Homo sapiens
  Payload ID: 10597
  Gene Symbol: MUC4
  Gene Name: mucin 4, cell surface associated
  ENSP ID: ENSP00000419989
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYASQAGTLWPWWLRSGTMLTSPLVGGPHFIRNTRRSMVNTAC

SEQ ID NO: 53208 - protein, 5360 aa, Homo sapiens
  Payload ID: 10597
  Gene Symbol: MUC4
  Gene Name: mucin 4, cell surface associated
  ENSP ID: ENSP00000420243
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53209 - protein, 4444 aa, Homo sapiens
  Payload ID: 10597
  Gene Symbol: MUC4
  Gene Name: mucin 4, cell surface associated
  ENSP ID: ENSP00000420439
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYASQAGTLWPWWLRSGTMLTSPLVGGPHFIRATPTKPSSPRTGAGPMPCFSTRAVGCSGTWPSAQWRWLFRKQPTDVPASVGEVSP

SEQ ID NO: 53210 - protein, 604 aa, Homo sapiens
  Payload ID: 10597
  Gene Symbol: MUC4
  Gene Name: mucin 4, cell surface associated
  ENSP ID: ENSP00000477983
GHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTS

SEQ ID NO: 53211 - protein, 5314 aa, Homo sapiens
  Payload ID: 10597
  Gene Symbol: MUC4
  Gene Name: mucin 4, cell surface associated
  ENSP ID: ENSP00000478400
SLPPSACGPRVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPVTFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGAAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSSGLTSPQTQTHTLSPSGSGKTFTTALISNATPLPVTYASSASTGHTTPLHVTDASSVSTGHATPLPVTSPSSVSTGHTTPLPVTDTSSESTGHVTPLPVTSLSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGDTTPLHVTDASSASTGQDTPLPVTSLSSVSTGDTTPLPVTSPSSASTGHATPLLVTDASSVSTGHATSLLVTDASSVSTGHATALHVTSPSSASTGDTTPLPVTDTSSASTGHATSLPVTDTSSASTGHATPLPVTDTSSASTGQATPLPVTGPSSASTGHATSLPVTSLSSVSTGDTTPLPVTSPSSASSGHTTPLPVTDASSVSTGHTTPLPVTDASSASTGHATPLPVTSTSSASTGDTTPLPVTSPSSASTGHATSLPVTDTSSVSTGHATSLPVTDASSVFTGHATSLPVTIPSSASSGHTTPLPVTDASSVSTGHATSLPVTDASSVSTGDTTPLPVTDTSSASTGHATPLHVTSPSSASTGHATPLPVTSLSSVSTGDTTPLPVTSPSSASTGHTTPLPVTDTSSASTGQATALPVTSTSSASTGDTTPLPVTDTSSASTGDTTPLPVTSPSSASTGHATPLPVTDTSSAYTGDTTSLPVTDTSSSSTGHATPLHVTSPSSASTGQATPLPVTNTSSASTGHATPLPVTGLSSASTGDTTRLPVTDISSASTGQATPLPVTNTSSVSTGDTMPLPVTSPSSASTGHATPLPVTDASSASTGHATPLPVTDTSSVSTGHATPLPLTSLSSVSTGDTTPLPVTDASSASTGHATPLPVTSLSSVSTGDTTPLPVTDASSASTGDTTPLPVTIPSSASSGHTTSLPVTDTSSVSTGDTTPLLVTDASSVSTGHATPLPVTDTSSASTGDTTRLPVTDTSSASTGQATPLPVTSLSSVSTGDTTPLLVTSTSSASTGHATSLPVTDTSSVSTGHATSLPVTDTSSVSTGHATPLPVTDASSVSTGHATPLPVTDTSSASTGQATPLPVTSLSSVSTGDTMPLPVTDASSASTGQATLLPVTSLSSVSTGDTTPLPVTSPSSASTGHATPLLVTDTSSASTGHATPLPVTDASSVSTGHATSLPVTDTSSVSTGDTTPLPVTSPSSASTGDTTPLPVTDASSVSTGHTTPLPVTDTSSASTGHATPLHVTSPSSASTGHATPLPVTSTSSASTGHATSLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTSPSSASTGDTTPLPVTDASSASTGHATSLLVTDASSVSTGDTTPLPVTDTNSASTGDTTPLHVTDASSVSTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTSSASTGDTTPLPVTNASSLSTGHATPLHVTSPSSASTGHATPLPVTSTSSASTGHATPLPVTSTSSASTDDTTRLPVTDVSSASTGQATPLPVTSLSSVSTGDTTPLPVTSPSSASTGHASPLLVTDASSASTGQATPLPVTGLSSASTDDTTRLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTSLSSASSTGDTTPLPVTDTSSASTGQDTPLPVTSLFSVSTGDTTPLPVTDASSVSTGHATSLLVTDASSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGHATPLPVTSTSSASTGDTTPLPVTSPSSASTGHTTPLPVTDTPSASTGDTTPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPVTDTSSISTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSLASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSVSTGHVTPLHVTSPSSASTGHATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53212 - protein, 2143 aa, Homo sapiens
  Payload ID: 10597
  Gene Symbol: MUC4
  Gene Name: mucin 4, cell surface associated
  ENSP ID: ENSP00000478625
PGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPVTFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGAAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSSGLTSPQTQTHTLSPSGSGKTFTTALISNATPLPVTYASSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53213 - protein, 1149 aa, Homo sapiens
  Payload ID: 10597
  Gene Symbol: MUC4
  Gene Name: mucin 4, cell surface associated
  ENSP ID: ENSP00000479199
  MOD_RES (1)..(1): Any amino acid
XMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53214 - protein, 5385 aa, Homo sapiens
  Payload ID: 10597
  Gene Symbol: MUC4
  Gene Name: mucin 4, cell surface associated
  ENSP ID: ENSP00000479614
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53215 - protein, 5333 aa, Homo sapiens
  Payload ID: 10597
  Gene Symbol: MUC4
  Gene Name: mucin 4, cell surface associated
  ENSP ID: ENSP00000480194
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53216 - protein, 4969 aa, Homo sapiens
  Payload ID: 10597
  Gene Symbol: MUC4
  Gene Name: mucin 4, cell surface associated
  ENSP ID: ENSP00000480691
PGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELF

SEQ ID NO: 53217 - protein, 4969 aa, Homo sapiens; identical to SEQ ID NO: 53216
  Payload ID: 10597
  Gene Symbol: MUC4
  Gene Name: mucin 4, cell surface associated
  ENSP ID: ENSP00000480849

SEQ ID NO: 53218 - protein, 609 aa, Homo sapiens
  Payload ID: 10597
  Gene Symbol: MUC4
  Gene Name: mucin 4, cell surface associated
  ENSP ID: ENSP00000481308
SSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTS

SEQ ID NO: 53219 - protein, 1149 aa, Homo sapiens; identical to SEQ ID NO: 53213
  Payload ID: 10597
  Gene Symbol: MUC4
  Gene Name: mucin 4, cell surface associated
  ENSP ID: ENSP00000481518
  MOD_RES (1)..(1): Any amino acid

SEQ ID NO: 53220 - protein, 2138 aa, Homo sapiens
  Payload ID: 10597
  Gene Symbol: MUC4
  Gene Name: mucin 4, cell surface associated
  ENSP ID: ENSP00000481623
PGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53221 - protein, 5385 aa, Homo sapiens; identical to SEQ ID NO: 53214
  Payload ID: 10597
  Gene Symbol: MUC4
  Gene Name: mucin 4, cell surface associated
  ENSP ID: ENSP00000481715
  MOD_RES (1)..(1): Any amino acid

SEQ ID NO: 53222 - protein, 5333 aa, Homo sapiens; identical to SEQ ID NO: 53215
  Payload ID: 10597
  Gene Symbol: MUC4
  Gene Name: mucin 4, cell surface associated
  ENSP ID: ENSP00000482172
  MOD_RES (1)..(1): Any amino acid

SEQ ID NO: 53223 - protein, 2138 aa, Homo sapiens
  Payload ID: 10597
  Gene Symbol: MUC4
  Gene Name: mucin 4, cell surface associated
  ENSP ID: ENSP00000482178
PGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53224 - protein, 167 aa, Homo sapiens
  Payload ID: 10597
  Gene Symbol: MUC4
  Gene Name: mucin 4, cell surface associated
  ENSP ID: ENSP00000482417
  MOD_RES (1)..(1): Any amino acid
XMTTPSLKTDGGRRTATSPPPTTSQTIISTIPSTAMHTRSTAAPIPILPERGEAIQEFPSSPMGQTPGTWSSSGGPWTSPPHSSSRRLASPLAPLSVIPSTSQTMARSSSQSQTTRFSPTPTHSQQASQAGTLWPWWLRSGTMLTSPLVGGPHFIRNTRRSMVNTAC

SEQ ID NO: 53225 - protein, 2138 aa, Homo sapiens; identical to SEQ ID NO: 53223
  Payload ID: 10597
  Gene Symbol: MUC4
  Gene Name: mucin 4, cell surface associated
  ENSP ID: ENSP00000483270

SEQ ID NO: 53226 - protein, 604 aa, Homo sapiens; identical to SEQ ID NO: 53210
  Payload ID: 10597
  Gene Symbol: MUC4
  Gene Name: mucin 4, cell surface associated
  ENSP ID: ENSP00000483919

SEQ ID NO: 53227 - protein, 5385 aa, Homo sapiens; identical to SEQ ID NO: 53214
  Payload ID: 10597
  Gene Symbol: MUC4
  Gene Name: mucin 4, cell surface associated
  ENSP ID: ENSP00000485685
  MOD_RES (1)..(1): Any amino acid

SEQ ID NO: 53228 - protein, 4393 aa, Homo sapiens
  Payload ID: 10597
  Gene Symbol: MUC4
  Gene Name: mucin 4, cell surface associated
  ENSP ID: ENSP00000485714
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGEAIQEFPSSPMGQAPGTWSSSGGPWTSPPHSSSRRLASPLAPLSVIPSTSQTMARSSSQSQTTRFSPTPTHSQQASQAGTLWPWWLRSGTMLTSPLVGGPHFIRL

SEQ ID NO: 53229 - protein, 144 aa, Homo sapiens; identical to SEQ ID NO: 53196
  Payload ID: 10597
  Gene Symbol: MUC4
  Gene Name: mucin 4, cell surface associated
  ENSP ID: ENSP00000485725
  MOD_RES (1)..(1): Any amino acid

SEQ ID NO: 53230 - protein, 1098 aa, Homo sapiens
  Payload ID: 10597
  Gene Symbol: MUC4
  Gene Name: mucin 4, cell surface associated
  ENSP ID: ENSP00000485734
  MOD_RES (1)..(1): Any amino acid
XVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53231 - protein, 5044 aa, Homo sapiens
  Payload ID: 10597
  Gene Symbol: MUC4
  Gene Name: mucin 4, cell surface associated
  ENSP ID: ENSP00000485749
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGHAPHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSSSTGQATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLELWGALSCVRTSPAL

SEQ ID NO: 53232 - protein, 6436 aa, Homo sapiens
  Payload ID: 10597
  Gene Symbol: MUC4
  Gene Name: mucin 4, cell surface associated
  ENSP ID: ENSP00000485768
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPVTFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGAAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSSGLTSPQTQTHTLSPSGSGKTFTTALISNATPLPVTYASSASTGHTTPLHVTDASSVSTGHATPLPVTDTSSESTGHATPLPVTSPSSVSTGHTTPLPVTDTSSESTGHVTPLPVTSLSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTSPSSASTGHATPLLVTDASSVSTGHATSLLVTDASSVSTGHATALHVTDASSLSTGDTTPLPVTSPSSASTGDTTPLPVTDTSSASTGHATSLPVTDTSSASTGHATPLPVTDTSSASTGQATPLPVTGPSSASTGHAIPLLVTDTSSASTGQATPLPVTSLSSASTGDTTPLPVTDASSVSTGHATSLPVTSLSSVSTGDTTPLPVTSPSSASSGHTTPLPVTDASSVSTGDTTPLPVTSPSSASSGHTTPLPVTSPSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHTTSLHVTSPSSASTGHATSLPVTDTSSVSTGHATPLHVTSPSSASTGDTTPLPVTDTYSASTGQATPLPVTDTSSASTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPVTDTSSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATPLPVTDTSSASTGHATLLPVTDTSSASIGHATPLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTDTSSAYTGDTTSLPVTDTSSSSTGDTTPLLVTETSSASTGHATPLHVTSPSSASTGDTTPVPVTDTSSVSTGHATPLPVTGLSSASTGDTTRLPVTDISSASTGQATPLPVTNTSSASTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSFSSVSTGDTTPLPVTDTSSVSTGHATPLPVTSFSSVSTGDTTPLPVTDASSASTGHATPLPVTDTSSVSTGHATPLPLTSLSSVSTGDTTTLPVTDTSSVSTGHATPLPVTSFSSVSTGDTTPLPVTDASSASTGHATPLPVTDTSSVSTGHATPLPVTSLSSVSTGDTTPLPVTDASSASTGQATPLPVTSLSSVSTGDTTPLPVTIPSSASSGHTTSLPVTDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSRGHATSLPVTIPSSSSSGHTTPLPVTSTSSVSTGHVTPLPVTSTSSASTGHATSLPVTDTSSVSTGHATSLPVTDTSSVSTGHATPLPVTDASSVSTGHATPLPVTDASSASTGDTTPLPVTNTSSASTGQATPLPVTSLSSVSTGDTMPLPVTSPSSASTGHATPLPVTGLSSASTGDTTPLPVTDTSSASTGHVTPLPVTSLSSASTGDSTPLPVTDTSSASTGHVTPLPVTSLSSASTGDTTPLPVTDTSSASTGHATPLHVTDASSASTGQATLLPVTSLSSVSTGDTTPLPVTSPSSASTGHATPLLVTDTSSASTGHATPLPVTDASSVSTGHATSLPVTIRSSGSTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTTSASKGDTTPLPVTSPSSASTGHTTPLPVTDTSSASTGDTTPLPVTSPSSASTGHATPLPVTNASSLSTGHATPLHVTSPSSASTGHATPLPVTSTSSASTGHATSLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPVTDTSSISTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSLASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSVSTGHVTPLHVTSPSSASTGHATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGEAIQEFPSSPMGQTPGTWSSSGGPWTSPPHSSSRRLASPLAPLSVIPSTSQTMARSSSQSQTTRFSPTPTHSQQASQAGTLWPWWLRSGTMLTSPLVGGPHFIRNTRRSMVNTAC

SEQ ID NO: 53233 - protein, 4373 aa, Homo sapiens
  Payload ID: 10597
  Gene Symbol: MUC4
  Gene Name: mucin 4, cell surface associated
  ENSP ID: ENSP00000485821
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYASQAGTLWPWWLRSGTMLTSPLVGGPHFIRNTRRSMVNTAC

SEQ ID NO: 53234 - protein, 5333 aa, Homo sapiens; identical to SEQ ID NO: 53215
  Payload ID: 10597
  Gene Symbol: MUC4
  Gene Name: mucin 4, cell surface associated
  ENSP ID: ENSP00000485835
  MOD_RES (1)..(1): Any amino acid

SEQ ID NO: 53235 - protein, 6516 aa, Homo sapiens
  Payload ID: 10597
  Gene Symbol: MUC4
  Gene Name: mucin 4, cell surface associated
  ENSP ID: ENSP00000485865
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPVTFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGAAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSSGLTSPQTQTHTLSPSGSGKTFTTALISNATPLPVTYASSASTGHTTPLHVTDASSVSTGHATPLPVTDTSSESTGHATPLPVTSPSSVSTGHTTPLPVTDTSSESTGHVTPLPVTSLSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTSPSSASTGHATPLLVTDASSVSTGHATSLLVTDASSVSTGHATALHVTDASSLSTGDTTPLPVTSPSSASTGDTTPLPVTDTSSASTGHATSLPVTDTSSASTGHATPLPVTDTSSASTGQATPLPVTGPSSASTGHAIPLLVTDTSSASTGQATPLPVTSLSSASTGDTTPLPVTDASSVSTGHATSLPVTSLSSVSTGDTTPLPVTSPSSASSGHTTPLPVTDASSVSTGDTTPLPVTSPSSASSGHTTPLPVTSPSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHTTSLHVTSPSSASTGHATSLPVTDTSSVSTGHATPLHVTSPSSASTGDTTPLPVTDTYSASTGQATPLPVTDTSSASTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPVTDTSSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATPLPVTDTSSASTGHATLLPVTDTSSASIGHATPLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTDTSSAYTGDTTSLPVTDTSSSSTGDTTPLLVTETSSASTGHATPLHVTSPSSASTGDTTPVPVTDTSSVSTGHATPLPVTGLSSASTGDTTRLPVTDISSASTGQATPLPVTNTSSASTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSFSSVSTGDTTPLPVTDTSSVSTGHATPLPVTSFSSVSTGDTTPLPVTDASSASTGHATPLPVTDTSSVSTGHATPLPLTSLSSVSTGDTTTLPVTDTSSVSTGHATPLPVTSFSSVSTGDTTPLPVTDASSASTGHATPLPVTDTSSVSTGHATPLPVTSLSSVSTGDTTPLPVTDASSASTGQATPLPVTSLSSVSTGDTTPLPVTIPSSASSGHTTSLPVTDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSRGHATSLPVTIPSSSSSGHTTPLPVTSTSSVSTGHVTPLPVTSTSSASTGHATSLPVTDTSSVSTGHATSLPVTDTSSVSTGHATPLPVTDASSVSTGHATPLPVTDASSASTGDTTPLPVTNTSSASTGQATPLPVTSLSSVSTGDTMPLPVTSPSSASTGHATPLPVTGLSSASTGDTTPLPVTDTSSASTGHVTPLPVTSLSSASTGDSTPLPVTDTSSASTGHVTPLPVTSLSSASTGDTTPLPVTDTSSASTGHATPLHVTDASSASTGQATLLPVTSLSSVSTGDTTPLPVTSPSSASTGHATPLLVTDTSSASTGHATPLPVTDASSVSTGHATSLPVTIRSSGSTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTTSASKGDTTPLPVTSPSSASTGHTTPLPVTDTSSASTGDTTPLPVTSPSSASTGHATPLPVTNASSLSTGHATPLHVTSPSSASTGHATPLPVTSTSSASTGHATSLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPVTDTSSISTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSLASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSVSTGHVTPLHVTSPSSASTGHATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSVEMAISKTAH

SEQ ID NO: 53236 - protein, 4403 aa, Homo sapiens
  Payload ID: 10597
  Gene Symbol: MUC4
  Gene Name: mucin 4, cell surface associated
  ENSP ID: ENSP00000485874
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGEAIQEFPSSPMGQAPGTWSSSGGPWTSPPHSSSRRLASPLAPLSVIPSTSQTMARSSSQSQTTRFSPTPTHSQQASQAGTLWPWWLRSGTMLTSPLVGGPHFIRNTRRSMVNTAC

SEQ ID NO: 53237 - protein, 1149 aa, Homo sapiens
  Payload ID: 10597
  Gene Symbol: MUC4
  Gene Name: mucin 4, cell surface associated
  ENSP ID: ENSP00000485898
  MOD_RES (1)..(1): Any amino acid
XMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53238 - protein, 7076 aa, Homo sapiens
  Payload ID: 10597
  Gene Symbol: MUC4
  Gene Name: mucin 4, cell surface associated
  ENSP ID: ENSP00000485944
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPVTFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGAAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSSGLTSPQTQTHTLSPSGSGKTFTTALISNATPLPVTYASSASTGHTTPLHVTDASSVSTGHATPLPVTDTSSESTGHATPLPVTSPSSVSTGHTTPLPVTDTSSESTGHVTPLPVTSLSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTSPSSASTGHATPLLVTDASSVSTGHATSLLVTDASSVSTGHATALHVTDASSLSTGDTTPLPVTSPSSASTGDTTPLPVTDTSSASTGHATSLPVTDTSSASTGHATPLPVTDTSSASTGQATPLPVTGPSSASTGHAIPLLVTDTSSASTGQATPLPVTSLSSASTGDTTPLPVTDASSVSTGHATSLPVTSLSSVSTGDTTPLPVTSPSSASSGHTTPLPVTDASSVSTGDTTPLPVTSPSSASSGHTTPLPVTSPSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHTTSLHVTSPSSASTGHATSLPVTDTSSVSTGHATPLHVTSPSSASTGDTTPLPVTDTYSASTGQATPLPVTDTSSASTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPVTDTSSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATPLPVTDTSSASTGHATLLPVTDTSSASIGHATPLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTDTSSAYTGDTTSLPVTDTSSSSTGDTTPLLVTETSSASTGHATPLHVTSPSSASTGDTTPVPVTDTSSVSTGHATPLPVTGLSSASTGDTTRLPVTDISSASTGQATPLPVTNTSSASTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSFSSVSTGDTTPLPVTDTSSVSTGHATPLPVTSFSSVSTGDTTPLPVTDASSASTGHATPLPVTDTSSVSTGHATPLPLTSLSSVSTGDTTTLPVTDTSSVSTGHATPLPVTSFSSVSTGDTTPLPVTDASSASTGHATPLPVTDTSSVSTGHATPLPVTSLSSVSTGDTTPLPVTDASSASTGQATPLPVTSLSSVSTGDTTPLPVTIPSSASSGHTTSLPVTDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSRGHATSLPVTIPSSSSSGHTTPLPVTSTSSVSTGHVTPLPVTSTSSASTGHATSLPVTDTSSVSTGHATSLPVTDTSSVSTGHATPLPVTDASSVSTGHATPLPVTDASSASTGDTTPLPVTNTSSASTGQATPLPVTSLSSVSTGDTMPLPVTSPSSASTGHATPLPVTGLSSASTGDTTPLPVTDTSSASTGHVTPLPVTSLSSASTGDSTPLPVTDTSSASTGHVTPLPVTSLSSASTGDTTPLPVTDTSSASTGHATPLHVTDASSASTGQATLLPVTSLSSVSTGDTTPLPVTSPSSASTGHATPLLVTDTSSASTGHATPLPVTDASSVSTGHATSLPVTIRSSGSTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTTSASKGDTTPLPVTSPSSASTGHTTPLPVTDTSSASTGDTTPLPVTSPSSASTGHATPLPVTNASSLSTGHATPLHVTSPSSASTGHATPLPVTSTSSASTGHATSLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPVTDTSSISTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSLASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSVSTGHVTPLHVTSPSSASTGHATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLELWGALSCVRTSPAL

SEQ ID NO: 53239 - protein, 4403 aa, Homo sapiens; identical to SEQ ID NO: 53236
  Payload ID: 10597
  Gene Symbol: MUC4
  Gene Name: mucin 4, cell surface associated
  ENSP ID: ENSP00000485964
  MOD_RES (1)..(1): Any amino acid

SEQ ID NO: 53240 - protein, 174 aa, Homo sapiens; identical to SEQ ID NO: 53194
  Payload ID: 10597
  Gene Symbol: MUC4
  Gene Name: mucin 4, cell surface associated
  ENSP ID: ENSP00000486002
  MOD_RES (1)..(1): Any amino acid

SEQ ID NO: 53241 - protein, 4431 aa, Homo sapiens
  Payload ID: 10597
  Gene Symbol: MUC4
  Gene Name: mucin 4, cell surface associated
  ENSP ID: ENSP00000486023
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQSNTYQAILSTDGSRSYALFLYQSGGMQWDVAQRSVEMAISKTAH

SEQ ID NO: 53242 - protein, 5385 aa, Homo sapiens; identical to SEQ ID NO: 53214
  Payload ID: 10597
  Gene Symbol: MUC4
  Gene Name: mucin 4, cell surface associated
  ENSP ID: ENSP00000486046
  MOD_RES (1)..(1): Any amino acid

SEQ ID NO: 53243 - protein, 4415 aa, Homo sapiens
  Payload ID: 10597
  Gene Symbol: MUC4
  Gene Name: mucin 4, cell surface associated
  ENSP ID: ENSP00000486075
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYASQAGTLWPWWLRSGTMLTSPLVGGPHFIRATPTKPSSPRTGAGPMPCFSTRAVGCSGTWPSAQATRCSWASLVEMAISKTAH

SEQ ID NO: 53244 - protein, 4417 aa, Homo sapiens
  Payload ID: 10597
  Gene Symbol: MUC4
  Gene Name: mucin 4, cell surface associated
  ENSP ID: ENSP00000486101
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYASQAGTLWPWWLRSGTMLTSPLVGGPHFIRATPTKPSSPRTGAGPMPCFSTRAVGCSGTWPSAQWRWLFRKQPTDVPASVGEVSP

SEQ ID NO: 53245 - protein, 4415 aa, Homo sapiens; identical to SEQ ID NO: 53243
  Payload ID: 10597
  Gene Symbol: MUC4
  Gene Name: mucin 4, cell surface associated
  ENSP ID: ENSP00000486102
  MOD_RES (1)..(1): Any amino acid

SEQ ID NO: 53246 - protein, 164 aa, Homo sapiens; identical to SEQ ID NO: 53198
  Payload ID: 10597
  Gene Symbol: MUC4
  Gene Name: mucin 4, cell surface associated
  ENSP ID: ENSP00000486103
  MOD_RES (1)..(1): Any amino acid

SEQ ID NO: 53247 - protein, 5334 aa, Homo sapiens
  Payload ID: 10597
  Gene Symbol: MUC4
  Gene Name: mucin 4, cell surface associated
  ENSP ID: ENSP00000486164
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGHAPHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSSSTGQATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQSNTYQAILSTDGSRSYALFLYQSGGMQWDVAQRSGKPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53248 - protein, 5385 aa, Homo sapiens; identical to SEQ ID NO: 53214
  Payload ID: 10597
  Gene Symbol: MUC4
  Gene Name: mucin 4, cell surface associated
  ENSP ID: ENSP00000486183
  MOD_RES (1)..(1): Any amino acid

SEQ ID NO: 53249 - protein, 4417 aa, Homo sapiens; identical to SEQ ID NO: 53244
  Payload ID: 10597
  Gene Symbol: MUC4
  Gene Name: mucin 4, cell surface associated
  ENSP ID: ENSP00000486205
  MOD_RES (1)..(1): Any amino acid

SEQ ID NO: 53250 - protein, 5043 aa, Homo sapiens
  Payload ID: 10597
  Gene Symbol: MUC4
  Gene Name: mucin 4, cell surface associated
  ENSP ID: ENSP00000486210
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLELWGALSCVRTSPAL

SEQ ID NO: 53251 - protein, 4417 aa, Homo sapiens; identical to SEQ ID NO: 53244
  Payload ID: 10597
  Gene Symbol: MUC4
  Gene Name: mucin 4, cell surface associated
  ENSP ID: ENSP00000486243
  MOD_RES (1)..(1): Any amino acid

SEQ ID NO: 53252 - protein, 4415 aa, Homo sapiens; identical to SEQ ID NO: 53243
  Payload ID: 10597
  Gene Symbol: MUC4
  Gene Name: mucin 4, cell surface associated
  ENSP ID: ENSP00000486256
  MOD_RES (1)..(1): Any amino acid

SEQ ID NO: 53253 - protein, 174 aa, Homo sapiens; identical to SEQ ID NO: 53194
  Payload ID: 10597
  Gene Symbol: MUC4
  Gene Name: mucin 4, cell surface associated
  ENSP ID: ENSP00000486267
  MOD_RES (1)..(1): Any amino acid

SEQ ID NO: 53254 - protein, 4431 aa, Homo sapiens; identical to SEQ ID NO: 53241
  Payload ID: 10597
  Gene Symbol: MUC4
  Gene Name: mucin 4, cell surface associated
  ENSP ID: ENSP00000486305
  MOD_RES (1)..(1): Any amino acid

SEQ ID NO: 53255 - protein, 164 aa, Homo sapiens; identical to SEQ ID NO: 53198
  Payload ID: 10597
  Gene Symbol: MUC4
  Gene Name: mucin 4, cell surface associated
  ENSP ID: ENSP00000486358
  MOD_RES (1)..(1): Any amino acid

SEQ ID NO: 53256 - protein, 137 aa, Homo sapiens
  Payload ID: 10597
  Gene Symbol: MUC4
  Gene Name: mucin 4, cell surface associated
  ENSP ID: ENSP00000486372
  MOD_RES (1)..(1): Any amino acid
XMTTPSLKTDGGRRTATSPPPTTSQTIISTIPSTAMHTRSTAAPIPILPERGVSLFPYGADAGDLEFVRRTVDFTSPLFKPATGFPLGSSLRDSLYASQAGTLWPWWLRSGTMLTSPLVGGPHFIRNTRRSMVNTAC

SEQ ID NO: 53257 - protein, 4484 aa, Homo sapiens
  Payload ID: 10597
  Gene Symbol: MUC4
  Gene Name: mucin 4, cell surface associated
  ENSP ID: ENSP00000486425
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGHAPHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSSSTGQATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSVEMAISKTAH

SEQ ID NO: 53258 - protein, 6436 aa, Homo sapiens; identical to SEQ ID NO: 53232
  Payload ID: 10597
  Gene Symbol: MUC4
  Gene Name: mucin 4, cell surface associated
  ENSP ID: ENSP00000486429

SEQ ID NO: 53259 - protein, 157 aa, Homo sapiens
  Payload ID: 10597
  Gene Symbol: MUC4
  Gene Name: mucin 4, cell surface associated
  ENSP ID: ENSP00000486460
  MOD_RES (1)..(1): Any amino acid
XMTTPSLKTDGGRRTATSPPPTTSQTIISTIPSTAMHTRSTAAPIPILPERGEAIQEFPSSPMGQTPGTWSSSGGPWTSPPHSSSRRLASPLAPLSVIPSTSQTMARSSSQSQTTRFSPTPTHSQQASQAGTLWPWWLRSGTMLTSPLVGGPHFIRL

SEQ ID NO: 53260 - protein, 5043 aa, Homo sapiens; identical to SEQ ID NO: 53250
  Payload ID: 10597
  Gene Symbol: MUC4
  Gene Name: mucin 4, cell surface associated
  ENSP ID: ENSP00000486465
  MOD_RES (1)..(1): Any amino acid

SEQ ID NO: 53261 - protein, 4373 aa, Homo sapiens; identical to SEQ ID NO: 53233
  Payload ID: 10597
  Gene Symbol: MUC4
  Gene Name: mucin 4, cell surface associated
  ENSP ID: ENSP00000486489
  MOD_RES (1)..(1): Any amino acid

SEQ ID NO: 53262 - protein, 144 aa, Homo sapiens; identical to SEQ ID NO: 53196
  Payload ID: 10597
  Gene Symbol: MUC4
  Gene Name: mucin 4, cell surface associated
  ENSP ID: ENSP00000486497
  MOD_RES (1)..(1): Any amino acid

SEQ ID NO: 53263 - protein, 5333 aa, Homo sapiens; identical to SEQ ID NO: 53215
  Payload ID: 10597
  Gene Symbol: MUC4
  Gene Name: mucin 4, cell surface associated
  ENSP ID: ENSP00000486518
  MOD_RES (1)..(1): Any amino acid

SEQ ID NO: 53264 - protein, 4403 aa, Homo sapiens; identical to SEQ ID NO: 53236
  Payload ID: 10597
  Gene Symbol: MUC4
  Gene Name: mucin 4, cell surface associated
  ENSP ID: ENSP00000486522
  MOD_RES (1)..(1): Any amino acid

SEQ ID NO: 53265 - protein, 144 aa, Homo sapiens; identical to SEQ ID NO: 53196
  Payload ID: 10597
  Gene Symbol: MUC4
  Gene Name: mucin 4, cell surface associated
  ENSP ID: ENSP00000486529
  MOD_RES (1)..(1): Any amino acid

SEQ ID NO: 53266 - protein, 4403 aa, Homo sapiens; identical to SEQ ID NO: 53236
  Payload ID: 10597
  Gene Symbol: MUC4
  Gene Name: mucin 4, cell surface associated
  ENSP ID: ENSP00000486533
  MOD_RES (1)..(1): Any amino acid

SEQ ID NO: 53267 - protein, 4403 aa, Homo sapiens; identical to SEQ ID NO: 53236
  Payload ID: 10597
  Gene Symbol: MUC4
  Gene Name: mucin 4, cell surface associated
  ENSP ID: ENSP00000486541
  MOD_RES (1)..(1): Any amino acid

SEQ ID NO: 53268 - protein, 7366 aa, Homo sapiens
  Payload ID: 10597
  Gene Symbol: MUC4
  Gene Name: mucin 4, cell surface associated
  ENSP ID: ENSP00000486556
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPVTFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGAAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSSGLTSPQTQTHTLSPSGSGKTFTTALISNATPLPVTYASSASTGHTTPLHVTDASSVSTGHATPLPVTDTSSESTGHATPLPVTSPSSVSTGHTTPLPVTDTSSESTGHVTPLPVTSLSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTSPSSASTGHATPLLVTDASSVSTGHATSLLVTDASSVSTGHATALHVTDASSLSTGDTTPLPVTSPSSASTGDTTPLPVTDTSSASTGHATSLPVTDTSSASTGHATPLPVTDTSSASTGQATPLPVTGPSSASTGHAIPLLVTDTSSASTGQATPLPVTSLSSASTGDTTPLPVTDASSVSTGHATSLPVTSLSSVSTGDTTPLPVTSPSSASSGHTTPLPVTDASSVSTGDTTPLPVTSPSSASSGHTTPLPVTSPSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHTTSLHVTSPSSASTGHATSLPVTDTSSVSTGHATPLHVTSPSSASTGDTTPLPVTDTYSASTGQATPLPVTDTSSASTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPVTDTSSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATPLPVTDTSSASTGHATLLPVTDTSSASIGHATPLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTDTSSAYTGDTTSLPVTDTSSSSTGDTTPLLVTETSSASTGHATPLHVTSPSSASTGDTTPVPVTDTSSVSTGHATPLPVTGLSSASTGDTTRLPVTDISSASTGQATPLPVTNTSSASTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSFSSVSTGDTTPLPVTDTSSVSTGHATPLPVTSFSSVSTGDTTPLPVTDASSASTGHATPLPVTDTSSVSTGHATPLPLTSLSSVSTGDTTTLPVTDTSSVSTGHATPLPVTSFSSVSTGDTTPLPVTDASSASTGHATPLPVTDTSSVSTGHATPLPVTSLSSVSTGDTTPLPVTDASSASTGQATPLPVTSLSSVSTGDTTPLPVTIPSSASSGHTTSLPVTDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSRGHATSLPVTIPSSSSSGHTTPLPVTSTSSVSTGHVTPLPVTSTSSASTGHATSLPVTDTSSVSTGHATSLPVTDTSSVSTGHATPLPVTDASSVSTGHATPLPVTDASSASTGDTTPLPVTNTSSASTGQATPLPVTSLSSVSTGDTMPLPVTSPSSASTGHATPLPVTGLSSASTGDTTPLPVTDTSSASTGHVTPLPVTSLSSASTGDSTPLPVTDTSSASTGHVTPLPVTSLSSASTGDTTPLPVTDTSSASTGHATPLHVTDASSASTGQATLLPVTSLSSVSTGDTTPLPVTSPSSASTGHATPLLVTDTSSASTGHATPLPVTDASSVSTGHATSLPVTIRSSGSTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTTSASKGDTTPLPVTSPSSASTGHTTPLPVTDTSSASTGDTTPLPVTSPSSASTGHATPLPVTNASSLSTGHATPLHVTSPSSASTGHATPLPVTSTSSASTGHATSLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPVTDTSSISTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSLASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSVSTGHVTPLHVTSPSSASTGHATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53269 - protein, 5386 aa, Homo sapiens
  Payload ID: 10597
  Gene Symbol: MUC4
  Gene Name: mucin 4, cell surface associated
  ENSP ID: ENSP00000486565
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGHAPHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSSSTGQATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53270 - protein, 137 aa, Homo sapiens; identical to SEQ ID NO: 53256
  Payload ID: 10597
  Gene Symbol: MUC4
  Gene Name: mucin 4, cell surface associated
  ENSP ID: ENSP00000486641
  MOD_RES (1)..(1): Any amino acid

SEQ ID NO: 53271 - protein, 6448 aa, Homo sapiens
  Payload ID: 10597
  Gene Symbol: MUC4
  Gene Name: mucin 4, cell surface associated
  ENSP ID: ENSP00000486657
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPVTFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGAAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSSGLTSPQTQTHTLSPSGSGKTFTTALISNATPLPVTYASSASTGHTTPLHVTDASSVSTGHATPLPVTDTSSESTGHATPLPVTSPSSVSTGHTTPLPVTDTSSESTGHVTPLPVTSLSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTSPSSASTGHATPLLVTDASSVSTGHATSLLVTDASSVSTGHATALHVTDASSLSTGDTTPLPVTSPSSASTGDTTPLPVTDTSSASTGHATSLPVTDTSSASTGHATPLPVTDTSSASTGQATPLPVTGPSSASTGHAIPLLVTDTSSASTGQATPLPVTSLSSASTGDTTPLPVTDASSVSTGHATSLPVTSLSSVSTGDTTPLPVTSPSSASSGHTTPLPVTDASSVSTGDTTPLPVTSPSSASSGHTTPLPVTSPSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHTTSLHVTSPSSASTGHATSLPVTDTSSVSTGHATPLHVTSPSSASTGDTTPLPVTDTYSASTGQATPLPVTDTSSASTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPVTDTSSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATPLPVTDTSSASTGHATLLPVTDTSSASIGHATPLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTDTSSAYTGDTTSLPVTDTSSSSTGDTTPLLVTETSSASTGHATPLHVTSPSSASTGDTTPVPVTDTSSVSTGHATPLPVTGLSSASTGDTTRLPVTDISSASTGQATPLPVTNTSSASTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSFSSVSTGDTTPLPVTDTSSVSTGHATPLPVTSFSSVSTGDTTPLPVTDASSASTGHATPLPVTDTSSVSTGHATPLPLTSLSSVSTGDTTTLPVTDTSSVSTGHATPLPVTSFSSVSTGDTTPLPVTDASSASTGHATPLPVTDTSSVSTGHATPLPVTSLSSVSTGDTTPLPVTDASSASTGQATPLPVTSLSSVSTGDTTPLPVTIPSSASSGHTTSLPVTDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSRGHATSLPVTIPSSSSSGHTTPLPVTSTSSVSTGHVTPLPVTSTSSASTGHATSLPVTDTSSVSTGHATSLPVTDTSSVSTGHATPLPVTDASSVSTGHATPLPVTDASSASTGDTTPLPVTNTSSASTGQATPLPVTSLSSVSTGDTMPLPVTSPSSASTGHATPLPVTGLSSASTGDTTPLPVTDTSSASTGHVTPLPVTSLSSASTGDSTPLPVTDTSSASTGHVTPLPVTSLSSASTGDTTPLPVTDTSSASTGHATPLHVTDASSASTGQATLLPVTSLSSVSTGDTTPLPVTSPSSASTGHATPLLVTDTSSASTGHATPLPVTDASSVSTGHATSLPVTIRSSGSTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTTSASKGDTTPLPVTSPSSASTGHTTPLPVTDTSSASTGDTTPLPVTSPSSASTGHATPLPVTNASSLSTGHATPLHVTSPSSASTGHATPLPVTSTSSASTGHATSLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPVTDTSSISTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSLASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSVSTGHVTPLHVTSPSSASTGHATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYASQAGTLWPWWLRSGTMLTSPLVGGPHFIRATPTKPSSPRTGAGPMPCFSTRAVGCSGTWPSAQATRCSWASLVEMAISKTAH

SEQ ID NO: 53272 - protein, 4374 aa, Homo sapiens
  Payload ID: 10597
  Gene Symbol: MUC4
  Gene Name: mucin 4, cell surface associated
  ENSP ID: ENSP00000486683
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGHAPHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSSSTGQATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYASQAGTLWPWWLRSGTMLTSPLVGGPHFIRNTRRSMVNTAC

SEQ ID NO: 53273 - protein, 6464 aa, Homo sapiens
  Payload ID: 10597
  Gene Symbol: MUC4
  Gene Name: mucin 4, cell surface associated
  ENSP ID: ENSP00000486822
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPVTFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGAAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSSGLTSPQTQTHTLSPSGSGKTFTTALISNATPLPVTYASSASTGHTTPLHVTDASSVSTGHATPLPVTDTSSESTGHATPLPVTSPSSVSTGHTTPLPVTDTSSESTGHVTPLPVTSLSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTSPSSASTGHATPLLVTDASSVSTGHATSLLVTDASSVSTGHATALHVTDASSLSTGDTTPLPVTSPSSASTGDTTPLPVTDTSSASTGHATSLPVTDTSSASTGHATPLPVTDTSSASTGQATPLPVTGPSSASTGHAIPLLVTDTSSASTGQATPLPVTSLSSASTGDTTPLPVTDASSVSTGHATSLPVTSLSSVSTGDTTPLPVTSPSSASSGHTTPLPVTDASSVSTGDTTPLPVTSPSSASSGHTTPLPVTSPSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHTTSLHVTSPSSASTGHATSLPVTDTSSVSTGHATPLHVTSPSSASTGDTTPLPVTDTYSASTGQATPLPVTDTSSASTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPVTDTSSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATPLPVTDTSSASTGHATLLPVTDTSSASIGHATPLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTDTSSAYTGDTTSLPVTDTSSSSTGDTTPLLVTETSSASTGHATPLHVTSPSSASTGDTTPVPVTDTSSVSTGHATPLPVTGLSSASTGDTTRLPVTDISSASTGQATPLPVTNTSSASTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSFSSVSTGDTTPLPVTDTSSVSTGHATPLPVTSFSSVSTGDTTPLPVTDASSASTGHATPLPVTDTSSVSTGHATPLPLTSLSSVSTGDTTTLPVTDTSSVSTGHATPLPVTSFSSVSTGDTTPLPVTDASSASTGHATPLPVTDTSSVSTGHATPLPVTSLSSVSTGDTTPLPVTDASSASTGQATPLPVTSLSSVSTGDTTPLPVTIPSSASSGHTTSLPVTDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSRGHATSLPVTIPSSSSSGHTTPLPVTSTSSVSTGHVTPLPVTSTSSASTGHATSLPVTDTSSVSTGHATSLPVTDTSSVSTGHATPLPVTDASSVSTGHATPLPVTDASSASTGDTTPLPVTNTSSASTGQATPLPVTSLSSVSTGDTMPLPVTSPSSASTGHATPLPVTGLSSASTGDTTPLPVTDTSSASTGHVTPLPVTSLSSASTGDSTPLPVTDTSSASTGHVTPLPVTSLSSASTGDTTPLPVTDTSSASTGHATPLHVTDASSASTGQATLLPVTSLSSVSTGDTTPLPVTSPSSASTGHATPLLVTDTSSASTGHATPLPVTDASSVSTGHATSLPVTIRSSGSTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTTSASKGDTTPLPVTSPSSASTGHTTPLPVTDTSSASTGDTTPLPVTSPSSASTGHATPLPVTNASSLSTGHATPLHVTSPSSASTGHATPLPVTSTSSASTGHATSLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPVTDTSSISTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSLASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSVSTGHVTPLHVTSPSSASTGHATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQSNTYQAILSTDGSRSYALFLYQSGGMQWDVAQRSVEMAISKTAH

SEQ ID NO: 53274 - protein, 137 aa, Homo sapiens; identical to SEQ ID NO: 53256
  Payload ID: 10597
  Gene Symbol: MUC4
  Gene Name: mucin 4, cell surface associated
  ENSP ID: ENSP00000486827
  MOD_RES (1)..(1): Any amino acid

SEQ ID NO: 53275 - protein, 4483 aa, Homo sapiens
  Payload ID: 10597
  Gene Symbol: MUC4
  Gene Name: mucin 4, cell surface associated
  ENSP ID: ENSP00000486851
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSVEMAISKTAH

SEQ ID NO: 53276 - protein, 1149 aa, Homo sapiens; identical to SEQ ID NO: 53213
  Payload ID: 10597
  Gene Symbol: MUC4
  Gene Name: mucin 4, cell surface associated
  ENSP ID: ENSP00000486902
  MOD_RES (1)..(1): Any amino acid

SEQ ID NO: 53277 - protein, 137 aa, Homo sapiens; identical to SEQ ID NO: 53256
  Payload ID: 10597
  Gene Symbol: MUC4
  Gene Name: mucin 4, cell surface associated
  ENSP ID: ENSP00000486904
  MOD_RES (1)..(1): Any amino acid

SEQ ID NO: 53278 - protein, 144 aa, Homo sapiens; identical to SEQ ID NO: 53196
  Payload ID: 10597
  Gene Symbol: MUC4
  Gene Name: mucin 4, cell surface associated
  ENSP ID: ENSP00000486906
  MOD_RES (1)..(1): Any amino acid

SEQ ID NO: 53279 - protein, 4403 aa, Homo sapiens; identical to SEQ ID NO: 53236
  Payload ID: 10597
  Gene Symbol: MUC4
  Gene Name: mucin 4, cell surface associated
  ENSP ID: ENSP00000486911
  MOD_RES (1)..(1): Any amino acid

SEQ ID NO: 53280 - protein, 144 aa, Homo sapiens; identical to SEQ ID NO: 53196
  Payload ID: 10597
  Gene Symbol: MUC4
  Gene Name: mucin 4, cell surface associated
  ENSP ID: ENSP00000486925
  MOD_RES (1)..(1): Any amino acid

SEQ ID NO: 53281 - protein, 5043 aa, Homo sapiens; identical to SEQ ID NO: 53250
  Payload ID: 10597
  Gene Symbol: MUC4
  Gene Name: mucin 4, cell surface associated
  ENSP ID: ENSP00000486965
  MOD_RES (1)..(1): Any amino acid

SEQ ID NO: 53282 - protein, 4483 aa, Homo sapiens; identical to SEQ ID NO: 53275
  Payload ID: 10597
  Gene Symbol: MUC4
  Gene Name: mucin 4, cell surface associated
  ENSP ID: ENSP00000486982
  MOD_RES (1)..(1): Any amino acid

SEQ ID NO: 53283 - protein, 6406 aa, Homo sapiens
  Payload ID: 10597
  Gene Symbol: MUC4
  Gene Name: mucin 4, cell surface associated
  ENSP ID: ENSP00000487020
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPVTFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGAAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSSGLTSPQTQTHTLSPSGSGKTFTTALISNATPLPVTYASSASTGHTTPLHVTDASSVSTGHATPLPVTDTSSESTGHATPLPVTSPSSVSTGHTTPLPVTDTSSESTGHVTPLPVTSLSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTSPSSASTGHATPLLVTDASSVSTGHATSLLVTDASSVSTGHATALHVTDASSLSTGDTTPLPVTSPSSASTGDTTPLPVTDTSSASTGHATSLPVTDTSSASTGHATPLPVTDTSSASTGQATPLPVTGPSSASTGHAIPLLVTDTSSASTGQATPLPVTSLSSASTGDTTPLPVTDASSVSTGHATSLPVTSLSSVSTGDTTPLPVTSPSSASSGHTTPLPVTDASSVSTGDTTPLPVTSPSSASSGHTTPLPVTSPSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHTTSLHVTSPSSASTGHATSLPVTDTSSVSTGHATPLHVTSPSSASTGDTTPLPVTDTYSASTGQATPLPVTDTSSASTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPVTDTSSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATPLPVTDTSSASTGHATLLPVTDTSSASIGHATPLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTDTSSAYTGDTTSLPVTDTSSSSTGDTTPLLVTETSSASTGHATPLHVTSPSSASTGDTTPVPVTDTSSVSTGHATPLPVTGLSSASTGDTTRLPVTDISSASTGQATPLPVTNTSSASTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSFSSVSTGDTTPLPVTDTSSVSTGHATPLPVTSFSSVSTGDTTPLPVTDASSASTGHATPLPVTDTSSVSTGHATPLPLTSLSSVSTGDTTTLPVTDTSSVSTGHATPLPVTSFSSVSTGDTTPLPVTDASSASTGHATPLPVTDTSSVSTGHATPLPVTSLSSVSTGDTTPLPVTDASSASTGQATPLPVTSLSSVSTGDTTPLPVTIPSSASSGHTTSLPVTDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSRGHATSLPVTIPSSSSSGHTTPLPVTSTSSVSTGHVTPLPVTSTSSASTGHATSLPVTDTSSVSTGHATSLPVTDTSSVSTGHATPLPVTDASSVSTGHATPLPVTDASSASTGDTTPLPVTNTSSASTGQATPLPVTSLSSVSTGDTMPLPVTSPSSASTGHATPLPVTGLSSASTGDTTPLPVTDTSSASTGHVTPLPVTSLSSASTGDSTPLPVTDTSSASTGHVTPLPVTSLSSASTGDTTPLPVTDTSSASTGHATPLHVTDASSASTGQATLLPVTSLSSVSTGDTTPLPVTSPSSASTGHATPLLVTDTSSASTGHATPLPVTDASSVSTGHATSLPVTIRSSGSTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTTSASKGDTTPLPVTSPSSASTGHTTPLPVTDTSSASTGDTTPLPVTSPSSASTGHATPLPVTNASSLSTGHATPLHVTSPSSASTGHATPLPVTSTSSASTGHATSLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPVTDTSSISTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSLASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSVSTGHVTPLHVTSPSSASTGHATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYASQAGTLWPWWLRSGTMLTSPLVGGPHFIRNTRRSMVNTAC

SEQ ID NO: 53284 - protein, 5043 aa, Homo sapiens; identical to SEQ ID NO: 53250
  Payload ID: 10597
  Gene Symbol: MUC4
  Gene Name: mucin 4, cell surface associated
  ENSP ID: ENSP00000487046
  MOD_RES (1)..(1): Any amino acid

SEQ ID NO: 53285 - protein, 164 aa, Homo sapiens; identical to SEQ ID NO: 53198
  Payload ID: 10597
  Gene Symbol: MUC4
  Gene Name: mucin 4, cell surface associated
  ENSP ID: ENSP00000487052
  MOD_RES (1)..(1): Any amino acid

SEQ ID NO: 53286 - protein, 4373 aa, Homo sapiens; identical to SEQ ID NO: 53233
  Payload ID: 10597
  Gene Symbol: MUC4
  Gene Name: mucin 4, cell surface associated
  ENSP ID: ENSP00000487060
  MOD_RES (1)..(1): Any amino acid

SEQ ID NO: 53287 - protein, 137 aa, Homo sapiens; identical to SEQ ID NO: 53256
  Payload ID: 10597
  Gene Symbol: MUC4
  Gene Name: mucin 4, cell surface associated
  ENSP ID: ENSP00000487069
  MOD_RES (1)..(1): Any amino acid

SEQ ID NO: 53288 - protein, 1125 aa, Homo sapiens
  Payload ID: 10597
  Gene Symbol: MUC4
  Gene Name: mucin 4, cell surface associated
  ENSP ID: ENSP00000487084
MKGARWRRVPWVSLSCLCLCLLPHVVPGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53289 - protein, 174 aa, Homo sapiens; identical to SEQ ID NO: 53194
  Payload ID: 10597
  Gene Symbol: MUC4
  Gene Name: mucin 4, cell surface associated
  ENSP ID: ENSP00000487090
  MOD_RES (1)..(1): Any amino acid

SEQ ID NO: 53290 - protein, 4417 aa, Homo sapiens; identical to SEQ ID NO: 53244
  Payload ID: 10597
  Gene Symbol: MUC4
  Gene Name: mucin 4, cell surface associated
  ENSP ID: ENSP00000487096
  MOD_RES (1)..(1): Any amino acid

SEQ ID NO: 53291 - protein, 4373 aa, Homo sapiens; identical to SEQ ID NO: 53233
  Payload ID: 10597
  Gene Symbol: MUC4
  Gene Name: mucin 4, cell surface associated
  ENSP ID: ENSP00000487123
  MOD_RES (1)..(1): Any amino acid

SEQ ID NO: 53292 - protein, 144 aa, Homo sapiens; identical to SEQ ID NO: 53196
  Payload ID: 10597
  Gene Symbol: MUC4
  Gene Name: mucin 4, cell surface associated
  ENSP ID: ENSP00000487126
  MOD_RES (1)..(1): Any amino acid

SEQ ID NO: 53293 - protein, 4415 aa, Homo sapiens; identical to SEQ ID NO: 53243
  Payload ID: 10597
  Gene Symbol: MUC4
  Gene Name: mucin 4, cell surface associated
  ENSP ID: ENSP00000487131
  MOD_RES (1)..(1): Any amino acid

SEQ ID NO: 53294 - protein, 6450 aa, Homo sapiens
  Payload ID: 10597
  Gene Symbol: MUC4
  Gene Name: mucin 4, cell surface associated
  ENSP ID: ENSP00000487180
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPVTFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGAAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSSGLTSPQTQTHTLSPSGSGKTFTTALISNATPLPVTYASSASTGHTTPLHVTDASSVSTGHATPLPVTDTSSESTGHATPLPVTSPSSVSTGHTTPLPVTDTSSESTGHVTPLPVTSLSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTSPSSASTGHATPLLVTDASSVSTGHATSLLVTDASSVSTGHATALHVTDASSLSTGDTTPLPVTSPSSASTGDTTPLPVTDTSSASTGHATSLPVTDTSSASTGHATPLPVTDTSSASTGQATPLPVTGPSSASTGHAIPLLVTDTSSASTGQATPLPVTSLSSASTGDTTPLPVTDASSVSTGHATSLPVTSLSSVSTGDTTPLPVTSPSSASSGHTTPLPVTDASSVSTGDTTPLPVTSPSSASSGHTTPLPVTSPSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHTTSLHVTSPSSASTGHATSLPVTDTSSVSTGHATPLHVTSPSSASTGDTTPLPVTDTYSASTGQATPLPVTDTSSASTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPVTDTSSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATPLPVTDTSSASTGHATLLPVTDTSSASIGHATPLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTDTSSAYTGDTTSLPVTDTSSSSTGDTTPLLVTETSSASTGHATPLHVTSPSSASTGDTTPVPVTDTSSVSTGHATPLPVTGLSSASTGDTTRLPVTDISSASTGQATPLPVTNTSSASTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSFSSVSTGDTTPLPVTDTSSVSTGHATPLPVTSFSSVSTGDTTPLPVTDASSASTGHATPLPVTDTSSVSTGHATPLPLTSLSSVSTGDTTTLPVTDTSSVSTGHATPLPVTSFSSVSTGDTTPLPVTDASSASTGHATPLPVTDTSSVSTGHATPLPVTSLSSVSTGDTTPLPVTDASSASTGQATPLPVTSLSSVSTGDTTPLPVTIPSSASSGHTTSLPVTDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSRGHATSLPVTIPSSSSSGHTTPLPVTSTSSVSTGHVTPLPVTSTSSASTGHATSLPVTDTSSVSTGHATSLPVTDTSSVSTGHATPLPVTDASSVSTGHATPLPVTDASSASTGDTTPLPVTNTSSASTGQATPLPVTSLSSVSTGDTMPLPVTSPSSASTGHATPLPVTGLSSASTGDTTPLPVTDTSSASTGHVTPLPVTSLSSASTGDSTPLPVTDTSSASTGHVTPLPVTSLSSASTGDTTPLPVTDTSSASTGHATPLHVTDASSASTGQATLLPVTSLSSVSTGDTTPLPVTSPSSASTGHATPLLVTDTSSASTGHATPLPVTDASSVSTGHATSLPVTIRSSGSTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTTSASKGDTTPLPVTSPSSASTGHTTPLPVTDTSSASTGDTTPLPVTSPSSASTGHATPLPVTNASSLSTGHATPLHVTSPSSASTGHATPLPVTSTSSASTGHATSLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPVTDTSSISTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSLASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSVSTGHVTPLHVTSPSSASTGHATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYASQAGTLWPWWLRSGTMLTSPLVGGPHFIRATPTKPSSPRTGAGPMPCFSTRAVGCSGTWPSAQWRWLFRKQPTDVPASVGEVSP

SEQ ID NO: 53295 - protein, 4431 aa, Homo sapiens; identical to SEQ ID NO: 53241
  Payload ID: 10597
  Gene Symbol: MUC4
  Gene Name: mucin 4, cell surface associated
  ENSP ID: ENSP00000487226
  MOD_RES (1)..(1): Any amino acid

SEQ ID NO: 53296 - protein, 4483 aa, Homo sapiens; identical to SEQ ID NO: 53275
  Payload ID: 10597
  Gene Symbol: MUC4
  Gene Name: mucin 4, cell surface associated
  ENSP ID: ENSP00000487233
  MOD_RES (1)..(1): Any amino acid

SEQ ID NO: 53297 - protein, 1098 aa, Homo sapiens; identical to SEQ ID NO: 53230
  Payload ID: 10597
  Gene Symbol: MUC4
  Gene Name: mucin 4, cell surface associated
  ENSP ID: ENSP00000487235
  MOD_RES (1)..(1): Any amino acid

SEQ ID NO: 53298 - protein, 4373 aa, Homo sapiens; identical to SEQ ID NO: 53233
  Payload ID: 10597
  Gene Symbol: MUC4
  Gene Name: mucin 4, cell surface associated
  ENSP ID: ENSP00000487243
  MOD_RES (1)..(1): Any amino acid

SEQ ID NO: 53299 - protein, 144 aa, Homo sapiens; identical to SEQ ID NO: 53196
  Payload ID: 10597
  Gene Symbol: MUC4
  Gene Name: mucin 4, cell surface associated
  ENSP ID: ENSP00000487258
  MOD_RES (1)..(1): Any amino acid

SEQ ID NO: 53300 - protein, 4432 aa, Homo sapiens
  Payload ID: 10597
  Gene Symbol: MUC4
  Gene Name: mucin 4, cell surface associated
  ENSP ID: ENSP00000487270
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGHAPHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSSSTGQATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQSNTYQAILSTDGSRSYALFLYQSGGMQWDVAQRSVEMAISKTAH

SEQ ID NO: 53301 - protein, 4431 aa, Homo sapiens; identical to SEQ ID NO: 53241
  Payload ID: 10597
  Gene Symbol: MUC4
  Gene Name: mucin 4, cell surface associated
  ENSP ID: ENSP00000487312
  MOD_RES (1)..(1): Any amino acid

SEQ ID NO: 53302 - protein, 144 aa, Homo sapiens; identical to SEQ ID NO: 53196
  Payload ID: 10597
  Gene Symbol: MUC4
  Gene Name: mucin 4, cell surface associated
  ENSP ID: ENSP00000487320
  MOD_RES (1)..(1): Any amino acid

SEQ ID NO: 53303 - protein, 4403 aa, Homo sapiens; identical to SEQ ID NO: 53236
  Payload ID: 10597
  Gene Symbol: MUC4
  Gene Name: mucin 4, cell surface associated
  ENSP ID: ENSP00000487329
  MOD_RES (1)..(1): Any amino acid

SEQ ID NO: 53304 - protein, 4373 aa, Homo sapiens; identical to SEQ ID NO: 53233
  Payload ID: 10597
  Gene Symbol: MUC4
  Gene Name: mucin 4, cell surface associated
  ENSP ID: ENSP00000487354
  MOD_RES (1)..(1): Any amino acid

SEQ ID NO: 53305 - protein, 4373 aa, Homo sapiens; identical to SEQ ID NO: 53233
  Payload ID: 10597
  Gene Symbol: MUC4
  Gene Name: mucin 4, cell surface associated
  ENSP ID: ENSP00000487364
  MOD_RES (1)..(1): Any amino acid

SEQ ID NO: 53306 - protein, 7418 aa, Homo sapiens
  Payload ID: 10597
  Gene Symbol: MUC4
  Gene Name: mucin 4, cell surface associated
  ENSP ID: ENSP00000487383
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPVTFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGAAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSSGLTSPQTQTHTLSPSGSGKTFTTALISNATPLPVTYASSASTGHTTPLHVTDASSVSTGHATPLPVTDTSSESTGHATPLPVTSPSSVSTGHTTPLPVTDTSSESTGHVTPLPVTSLSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTSPSSASTGHATPLLVTDASSVSTGHATSLLVTDASSVSTGHATALHVTDASSLSTGDTTPLPVTSPSSASTGDTTPLPVTDTSSASTGHATSLPVTDTSSASTGHATPLPVTDTSSASTGQATPLPVTGPSSASTGHAIPLLVTDTSSASTGQATPLPVTSLSSASTGDTTPLPVTDASSVSTGHATSLPVTSLSSVSTGDTTPLPVTSPSSASSGHTTPLPVTDASSVSTGDTTPLPVTSPSSASSGHTTPLPVTSPSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHTTSLHVTSPSSASTGHATSLPVTDTSSVSTGHATPLHVTSPSSASTGDTTPLPVTDTYSASTGQATPLPVTDTSSASTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPVTDTSSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATPLPVTDTSSASTGHATLLPVTDTSSASIGHATPLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTDTSSAYTGDTTSLPVTDTSSSSTGDTTPLLVTETSSASTGHATPLHVTSPSSASTGDTTPVPVTDTSSVSTGHATPLPVTGLSSASTGDTTRLPVTDISSASTGQATPLPVTNTSSASTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSFSSVSTGDTTPLPVTDTSSVSTGHATPLPVTSFSSVSTGDTTPLPVTDASSASTGHATPLPVTDTSSVSTGHATPLPLTSLSSVSTGDTTTLPVTDTSSVSTGHATPLPVTSFSSVSTGDTTPLPVTDASSASTGHATPLPVTDTSSVSTGHATPLPVTSLSSVSTGDTTPLPVTDASSASTGQATPLPVTSLSSVSTGDTTPLPVTIPSSASSGHTTSLPVTDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSRGHATSLPVTIPSSSSSGHTTPLPVTSTSSVSTGHVTPLPVTSTSSASTGHATSLPVTDTSSVSTGHATSLPVTDTSSVSTGHATPLPVTDASSVSTGHATPLPVTDASSASTGDTTPLPVTNTSSASTGQATPLPVTSLSSVSTGDTMPLPVTSPSSASTGHATPLPVTGLSSASTGDTTPLPVTDTSSASTGHVTPLPVTSLSSASTGDSTPLPVTDTSSASTGHVTPLPVTSLSSASTGDTTPLPVTDTSSASTGHATPLHVTDASSASTGQATLLPVTSLSSVSTGDTTPLPVTSPSSASTGHATPLLVTDTSSASTGHATPLPVTDASSVSTGHATSLPVTIRSSGSTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTTSASKGDTTPLPVTSPSSASTGHTTPLPVTDTSSASTGDTTPLPVTSPSSASTGHATPLPVTNASSLSTGHATPLHVTSPSSASTGHATPLPVTSTSSASTGHATSLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPVTDTSSISTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSLASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSVSTGHVTPLHVTSPSSASTGHATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53307 - protein, 4483 aa, Homo sapiens; identical to SEQ ID NO: 53275
  Payload ID: 10597
  Gene Symbol: MUC4
  Gene Name: mucin 4, cell surface associated
  ENSP ID: ENSP00000487389
  MOD_RES (1)..(1): Any amino acid

SEQ ID NO: 53308 - protein, 4404 aa, Homo sapiens
  Payload ID: 10597
  Gene Symbol: MUC4
  Gene Name: mucin 4, cell surface associated
  ENSP ID: ENSP00000487409
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGHAPHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSSSTGQATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGEAIQEFPSSPMGQTPGTWSSSGGPWTSPPHSSSRRLASPLAPLSVIPSTSQTMARSSSQSQTTRFSPTPTHSQQASQAGTLWPWWLRSGTMLTSPLVGGPHFIRNTRRSMVNTAC

SEQ ID NO: 53309 - protein, 1098 aa, Homo sapiens; identical to SEQ ID NO: 53230
  Payload ID: 10597
  Gene Symbol: MUC4
  Gene Name: mucin 4, cell surface associated
  ENSP ID: ENSP00000487412
  MOD_RES (1)..(1): Any amino acid

SEQ ID NO: 53310 - protein, 144 aa, Homo sapiens; identical to SEQ ID NO: 53196
  Payload ID: 10597
  Gene Symbol: MUC4
  Gene Name: mucin 4, cell surface associated
  ENSP ID: ENSP00000487427
  MOD_RES (1)..(1): Any amino acid

SEQ ID NO: 53311 - protein, 4404 aa, Homo sapiens; identical to SEQ ID NO: 53308
  Payload ID: 10597
  Gene Symbol: MUC4
  Gene Name: mucin 4, cell surface associated
  ENSP ID: ENSP00000487451
  MOD_RES (1)..(1): Any amino acid

SEQ ID NO: 53312 - protein, 4403 aa, Homo sapiens; identical to SEQ ID NO: 53236
  Payload ID: 10597
  Gene Symbol: MUC4
  Gene Name: mucin 4, cell surface associated
  ENSP ID: ENSP00000487471
  MOD_RES (1)..(1): Any amino acid

SEQ ID NO: 53313 - protein, 1098 aa, Homo sapiens
  Payload ID: 10597
  Gene Symbol: MUC4
  Gene Name: mucin 4, cell surface associated
  ENSP ID: ENSP00000487492
  MOD_RES (1)..(1): Any amino acid
XVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53314 - protein, 4416 aa, Homo sapiens
  Payload ID: 10597
  Gene Symbol: MUC4
  Gene Name: mucin 4, cell surface associated
  ENSP ID: ENSP00000487502
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGHAPHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSSSTGQATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYASQAGTLWPWWLRSGTMLTSPLVGGPHFIRATPTKPSSPRTGAGPMPCFSTRAVGCSGTWPSAQASRCSWASLVEMAISKTAH

SEQ ID NO: 53315 - protein, 4403 aa, Homo sapiens; identical to SEQ ID NO: 53236
  Payload ID: 10597
  Gene Symbol: MUC4
  Gene Name: mucin 4, cell surface associated
  ENSP ID: ENSP00000487506
  MOD_RES (1)..(1): Any amino acid

SEQ ID NO: 53316 - protein, 1176 aa, Homo sapiens
  Payload ID: 10597
  Gene Symbol: MUC4
  Gene Name: mucin 4, cell surface associated
  ENSP ID: ENSP00000487522
MKGARWRRVPWVSLSCLCLCLLPHVVPGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 53317 - protein, 137 aa, Homo sapiens; identical to SEQ ID NO: 53256
  Payload ID: 10597
  Gene Symbol: MUC4
  Gene Name: mucin 4, cell surface associated
  ENSP ID: ENSP00000487547
  MOD_RES (1)..(1): Any amino acid

SEQ ID NO: 53318 - protein, 4418 aa, Homo sapiens
  Payload ID: 10597
  Gene Symbol: MUC4
  Gene Name: mucin 4, cell surface associated
  ENSP ID: ENSP00000487564
  MOD_RES (1)..(1): Any amino acid
XTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGHAPHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLHVTDASSVSTGHTTPLPVTDTSSASTGQATSLLVTDTSSVSTGDTTPLPVTSTSSASTGHVTPLHVTSPSSASTGHATPLPVTSLSSASTGDTTPLPVTDTSSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTSTSSASTGHATPLPVTDNSSVSTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTSLPVTDASSVSTGHATSLPVTIPSSASSGHTTPLPVTDASSVPTGHATSLPVTDASSVSTGHATPLPVTDASSVSTGHATPLPVTDTSSVSTGQATPLPVTSLSSASSTGDTTPLPVTDTSSASTGQDTPLPVTSLFSVSTGDTTPLPVTSPSSASTGHATHLLVTDASSVSTGHATSLLVTDASSVSTGHATALHVTDASSLSTGDTTPLPVTSPSSASTGDTTPLPVTDTSSVSTGHATSLPVTDTSSASTGHATSLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTSPSSASTGHATPLPVTSLSSASTGDTTPLPVTSPSSASTGHATPLHVTDASSVSTGDTTPLPVTSPSSASSGHTTPLPVTDASSASTGDTTPLPVTDTSSASTGHATHLPVTGLSSASTGDTTRLPVTDVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATPLPVTDTSAASTGHATPLPVTSTSSASTGDTTPLPVTDTSSASTGHATPLPVTNTSSVSTGHATPLHVTSPSSASTGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLHVTSPSSASTGHATPLPVTDTSSASTGHATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTSPSSASTGHTTPLPVTDTSSASTGDTTPLPVTNASSLSTGHTTPLHVTIPSSASTGDTSTLPVTGASSASTGHATPLPVTDTSSVSTGHATPLPVTSFSSVSTGDTTPLPVTDASSASTGHATPLPVTDTSSASTGDTTPLPVTDASSASTGQATPLPVTSLSSVSTGDTTPLPVTIPSSASSGHTTSLPVSDTSSASTGQATPLPVTSLSSVSTGDTTPLLVTDASSVSTGHATPLPVTDTSSASTGDTTRLPVTDTSSASTGQATPLPVTSLSSVSTGDTTPLLVTNTSSVSTGHATSLPVTIPSSSSSGHTTPLPVTSTSSVSTGHVTPLHVTSPSSSSTGQATPLPVTSTSSSSTGQATPLPVTSTSSASTGHATPLPVTDASSVSTGHATPLPVTDTSSASTGDTTPLPVTDTSSASTGQATPLPVTSLSSVSTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYASQAGTLWPWWLRSGTMLTSPLVGGPHFIRATPTKPSSPRTGAGPMPCFSTRAVGCSGTWPSAQWRWLFRKQPTDVPASVGEVSP

SEQ ID NO: 53319 - protein, 1098 aa, Homo sapiens; identical to SEQ ID NO: 53230
  Payload ID: 10597
  Gene Symbol: MUC4
  Gene Name: mucin 4, cell surface associated
  ENSP ID: ENSP00000487574
  MOD_RES (1)..(1): Any amino acid

SEQ ID NO: 53320 - protein, 167 aa, Homo sapiens; identical to SEQ ID NO: 53224
  Payload ID: 10597
  Gene Symbol: MUC4
  Gene Name: mucin 4, cell surface associated
  ENSP ID: ENSP00000487575
  MOD_RES (1)..(1): Any amino acid

SEQ ID NO: 53321 - protein, 157 aa, Homo sapiens; identical to SEQ ID NO: 53259
  Payload ID: 10597
  Gene Symbol: MUC4
  Gene Name: mucin 4, cell surface associated
  ENSP ID: ENSP00000487581
  MOD_RES (1)..(1): Any amino acid

SEQ ID NO: 53322 - protein, 5654 aa, Homo sapiens
  Payload ID: 10598
  Gene Symbol: MUC5AC
  Gene Name: mucin 5AC, oligomeric mucus/gel-forming
  Uniprot ID: P98088
  ENSP ID: ENSP00000485659
MSVGRRKLALLWALALALACTRHTGHAQDGSSESSYKHHPALSPIARGPSGVPLRGATVFPSLRTIPVVRASNPAHNGRVCSTWGSFHYKTFDGDVFRFPGLCNYVFSEHCGAAYEDFNIQLRRSQESAAPTLSRVLMKVDGVVIQLTKGSVLVNGHPVLLPFSQSGVLIQQSSSYTKVEARLGLVLMWNHDDSLLLELDTKYANKTCGLCGDFNGMPVVSELLSHNTKLTPMEFGNLQKMDDPTDQCQDPVPEPPRNCSTGFGICEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGAQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVENEKYAQHWCSQLTDADGPFGRCHAAVKPGTYYSNCMFDTCNCERSEDCLCAALSSYVHACAAKGVQLGGWRDGVCTKPMTTCPKSMTYHYHVSTCQPTCRSLSEGDITCSVGFIPVDGCICPKGTFLDDTGKCVQASNCPCYHRGSMIPNGESVHDSGAICTCTHGKLSCIGGQAPAPVCAAPMVFFDCRNATPGDTGAGCQKSCHTLDMTCYSPQCVPGCVCPDGLVADGEGGCITAEDCPCVHNEASYRAGQTIRVGCNTCTCDSRMWRCTDDPCLATCAVYGDGHYLTFDGQSYSFNGDCEYTLVQNHCGGKDSTQDSFRVVTENVPCGTTGTTCSKAIKIFLGGFELKLSHGKVEVIGTDESQEVPYTIRQMGIYLVVDTDIGLVLLWDKKTSIFINLSPEFKGRVCGLCGNFDDIAVNDFATRSRSVVGDVLEFGNSWKLSPSCPDALAPKDPCTANPFRKSWAQKQCSILHGPTFAACHAHVEPARYYEACVNDACACDSGGDCECFCTAVAAYAQACHEVGLCVSWRTPSICPLFCDYYNPEGQCEWHYQPCGVPCLRTCRNPRGDCLRDVRGLEGCYPKCPPEAPIFDEDKMQCVATCPTPPLPPRCHVHGKSYRPGAVVPSDKNCQSCLCTERGVECTYKAEACVCTYNGQRFHPGDVIYHTTDGTGGCISARCGANGTIERRVYPCSPTTPVPPTTFSFSTPPLVVSSTHTPSNGPSSAHTGPPSSAWPTTAGTSPRTRLPTASASLPPVCGEKCLWSPWMDVSRPGRGTDSGDFDTLENLRAHGYRVCESPRSVECRAEDAPGVPLRALGQRVQCSPDVGLTCRNREQASGLCYNYQIRVQCCTPLPCSTSSSPAQTTPPTTSKTTETRASGSSAPSSTPGTVSLSTARTTPAPGTATSVKKTFSTPSPPPVPATSTSSMSTTAPGTSVVSSKPTPTEPSTSSCLQELCTWTEWIDGSYPAPGINGGDFDTFQNLRDEGYTFCESPRSVQCRAESFPNTPLADLGQDVICSHTEGLICLNKNQLPPICYNYEIRIQCCETVNVCRDITRLPKTVATTRPTPHPTGAQTQTTFTTHMPSASTEQPTATSRGGPTATSVTQGTHTTLVTRNCHPRCTWTKWFDVDFPSPGPHGGDKETYNNIIRSGEKICRRPEEITRLQCRAKSHPEVSIEHLGQVVQCSREEGLVCRNQDQQGPFKMCLNYEVRVLCCETPRGCHMTSTPGSTSSSPAQTTPSTTSKTTETQASGSSAPSSTPGTVSLSTARTTPAPGTATSVKKTFSTPSPPPVPATSTSSMSTTAPGTSVVSSKPTPTEPSTSSCLQELCTWTEWIDGSYPAPGINGGDFDTFQNLRDEGYTFCESPRSVQCRAESFPNTPLADLGQDVICSHTEGLICLNKNQLPPICYNYEIRIQCCETVNVCRDITRPPKTVATTRPTPHPTGAQTQTTFTTHMPSASTEQPTATSRGGPTATSVTQGTHTTPVTRNCHPRCTWTTWFDVDFPSPGPHGGDKETYNNIIRSGEKICRRPEEITRLQCRAKSHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTYAHTTSTTSAPTARTTSAPTTRTTSASPASTTSGPGNTPSPVPTTSTISAPTTSITSAPTTSTTSAPTSSTTSGPGTTPSPVPTTSITSAPTTSTTSAPTTSTTSARTSSTTSATTTSRISGPETTPSPVPTTSTTSATTTSTTSAPTTSTTSAPTSSTTSSPQTSTTSAPTTSTTSGPGTTPSPVPTTSTTSAPTTRTTSAPKSSTTSAATTSTTSGPETTPRPVPTTSTTSSPTTSTTSAPTTSTTSASTTSTTSGAGTTPSPVPTTSTTSAPTTSTTSAPISSTTSATTTSTTSGPGTTPSPVPTTSTTSAPTTSTTSGPGTTPSAVPTTSITSAPTTSTNSAPISSTTSATTTSRISGPETTPSPVPTASTTSASTTSTTSGPGTTPSPVPTTSTISVPTTSTTSASTTSTTSASTTSTTSGPGTTPSPVPTTSTTSAPTTSTTSAPTTSTISAPTTSTTSATTTSTTSAPTPRRTSAPTTSTISASTTSTTSATTTSTTSATTTSTISAPTTSTTLSPTTSTTSTTITSTTSAPISSTTSTPQTSTTSAPTTSTTSGPGTTSSPVPTTSTTSAPTTSTTSAPTTRTTSVPTSSTTSTATTSTTSGPGTTPSPVPTTSTTSAPTTRTTSAPTTSTTSAPTTSTTSAPTSSTTSATTTSTISVPTTSTTSVPGTTPSPVPTTSTISVPTTSTTSASTTSTTSGPGTTPSPVPTTSTTSAPTTSTTSAPTTSTISAPTTSTPSAPTTSTTLAPTTSTTSAPTTSTTSTPTSSTTSSPQTSTTSASTTSITSGPGTTPSPVPTTSTTSAPTTSTTSAATTSTISAPTTSTTSAPTTSTTSASTASKTSGLGTTPSPIPTTSTTSPPTTSTTSASTASKTSGPGTTPSPVPTTSTIFAPRTSTTSASTTSTTPGPGTTPSPVPTTSTASVSKTSTSHVSISKTTHSQPVTRDCHLRCTWTKWFDIDFPSPGPHGGDKETYNNIIRSGEKICRRPEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAPTTSTTSAPTTSTTSAPTTSTTSTPQTSISSAPTSSTTSAPTSSTISARTTSIISAPTTSTTSSPTTSTTSATTTSTTSAPTSSTTSTPQTSKTSAATSSTTSGSGTTPSPVTTTSTASVSKTSTSHVSVSKTTHSQPVTRDCHPRCTWTKWFDVDFPSPGPHGGDKETYNNIIRSGEKICRRPEEITRLQCRAKSHPEVSIEHLGQVVQCSREEGLVCRNQDQQGPFKMCLNYEVRVLCCETPKGCPVTSTSVTAPSTPSGRATSPTQSTSSWQKSRTTTLVTSSITSTTQTSTTSAPTTSTTPASIPSTTSAPTTSTTSAPTTSTTSAPTTSTTSTPQTTTSSAPTSSTTSAPTTSTISAPTTSTISAPTTSTTSAPTASTTSAPTSTSSAPTTNTTSAPTTSTTSAPITSTISAPTTSTTSTPQTSTISSPTTSTTSTPQTSTTSSPTTSTTSAPTTSTTSAPTTSTTSTPQTSISSAPTSSTTSAPTASTISAPTTSTTSFHTTSTTSPPTSSTSSTPQTSKTSAATSSTTSGSGTTPSPVPTTSTASVSKTSTSHVSVSKTTHSQPVTRDCHPRCTWTKWFDVDFPSPGPHGGDKETYNNIIRSGEKICRRPEEITRLQCRAESHPEVSIEHLGQVVQCSREEGLVCRNQDQQGPFKMCLNYEVRVLCCETPKGCPVTSTPVTAPSTPSGRATSPTQSTSSWQKSRTTTLVTTSTTSTPQTSTTSAPTTSTIPASTPSTTSAPTTSTTSAPTTSTTSAPTHRTTSGPTTSTTLAPTTSTTSAPTTSTNSAPTTSTISASTTSTISAPTTSTISSPTSSTTSTPQTSKTSAATSSTTSGSGTTPSPVPTTSTTSASTTSTTSAPTTSTTSGPGTTPSPVPSTSTTSAATTSTTSAPTTRTTSAPTSSMTSGPGTTPSPVPTTSTTSAPTTSTTSGPGTTPSPVPTTSTTSAPITSTTSGPGSTPSPVPTTSTTSAPTTSTTSASTASTTSGPGTTPSPVPTTSTTSAPTTRTTSASTASTTSGPGSTPSPVPTTSTTSAPTTRTTPASTASTTSGPGTTPSPVPTTSTTSASTTSTISLPTTSTTSAPITSMTSGPGTTPSPVPTTSTTSAPTTSTTSASTASTTSGPGTTPSPVPTTSTTSAPTTSTTSASTASTTSGPGTSLSPVPTTSTTSAPTTSTTSGPGTTPSPVPTTSTTSAPTTSTTSGPGTTPSPVPTTSTTPVSKTSTSHLSVSKTTHSQPVTSDCHPLCAWTKWFDVDFPSPGPHGGDKETYNNIIRSGEKICRRPEEITRLQCRAESHPEVNIEHLGQVVQCSREEGLVCRNQDQQGPFKMCLNYEVRVLCCETPRGCPVTSVTPYGTSPTNALYPSLSTSMVSASVASTSVASSSVASSSVAYSTQTCFCNVADRLYPAGSTIYRHRDLAGHCYYALCSQDCQVVRGVDSDCPSTTLPPAPATSPSISTSEPVTELGCPNAVPPRKKGETWATPNCSEATCEGNNVISLRPRTCPRVEKPTCANGYPAVKVADQDGCCHHYQCQCVCSGWGDPHYITFDGTYYTFLDNCTYVLVQQIVPVYGHFRVLVDNYFCGAEDGLSCPRSIILEYHQDRVVLTRKPVHGVMTNEIIFNNKVVSPGFRKNGIVVSRIGVKMYATIPELGVQVMFSGLIFSVEVPFSKFANNTEGQCGTCTNDRKDECRTPRGTVVASCSEMSGLWNVSIPDQPACHRPHPTPTTVGPTTVGSTTVGPTTVGSTTVGPTTPPAPCLPSPICQLILSKVFEPCHTVIPPLLFYEGCVFDRCHMTDLDVVCSSLELYAALCASHDICIDWRGRTGHMCPFTCPADKVYQPCGPSNPSYCYGNDSASLGALPEAGPITEGCFCPEGMTLFSTSAQVCVPTGCPRCLGPHGEPVKVGHTVGMDCQECTCEAATWTLTCRPKLCPLPPACPLPGFVPVPAAPQAGQCCPQYSCACNTSRCPAPVGCPEGARAIPTYQEGACCPVQNCSWTVCSINGTLYQPGAVVSSSLCETCRCELPGGPPSDAFVVSCETQICNTHCPVGFEYQEQSGQCCGTCVQVACVTNTSKSPAHLFYPGETWSDAGNHCVTHQCEKHQDGLVVVTTKKACPPLSCSLDEARMSKDGCCRFCPPPPPPYQNQSTCAVYHRSLIIQQQGCSSSEPVRLAYCRGNCGDSSSMYSLEGNTVEHRCQCCQELRTSLRNVTLHCTDGSSRAFSYTEVEECGCMGRRCPAPGDTQHSEEAEPEPSQEAESGSWERGVPVSPMH

SEQ ID NO: 53323 - protein, 153 aa, Homo sapiens
  Payload ID: 10599
  Gene Symbol: MUC5B
  Gene Name: mucin 5B, oligomeric mucus/gel-forming
  ENSP ID: ENSP00000434539
QPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQEAATGKAA

SEQ ID NO: 53324 - protein, 5762 aa, Homo sapiens
  Payload ID: 10599
  Gene Symbol: MUC5B
  Gene Name: mucin 5B, oligomeric mucus/gel-forming
  Uniprot ID: Q9HC84
  ENSP ID: ENSP00000436812
MGAPSACRTLVLALAAMLVVPQAETQGPVEPSWENAGHTMDGGAPTSSPTRRVSFVPPVTVFPSLSPLNPAHNGRVCSTWGDFHYKTFDGDVFRFPGLCNYVFSEHCRAAYEDFNVQLRRGLVGSRPVVTRVVIKAQGLVLEASNGSVLINGQREELPYSRTGLLVEQSGDYIKVSIRLVLTFLWNGEDSALLELDPKYANQTCGLCGDFNGLPAFNEFYAHNARLTPLQFGNLQKLDGPTEQCPDPLPLPAGNCTDEEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKYMQNCPKSQRYAYVVDACQPTCRGLSEADVTCSVSFVPVDGCTCPAGTFLNDAGACVPAQECPCYAHGTVLAPGEVVHDEGAVCSCTGGKLSCLGASLQKSTGCAAPMVYLDCSNSSAGTPGAECLRSCHTLDVGCFSTHCVSGCVCPPGLVSDGSGGCIAEEDCPCVHNEATYKPGETIRVDCNTCTCRNRRWECSHRLCLGTCVAYGDGHFITFDGDRYSFEGSCEYILAQDYCGDNTTHGTFRIVTENIPCGTTGTTCSKAIKLFVESYELILQEGTFKAVARGPGGDPPYKIRYMGIFLVIETHGMAVSWDRKTSVFIRLHQDYKGRVCGLCGNFDDNAINDFATRSRSVVGDALEFGNSWKLSPSCPDALAPKDPCTANPFRKSWAQKQCSILHGPTFAACRSQVDSTKYYEACVNDACACDSGGDCECFCTAVAAYAQACHDAGLCVSWRTPDTCPLFCDFYNPHGGCEWHYQPCGAPCLKTCRNPSGHCLVDLPGLEGCYPKCPPSQPFFNEDQMKCVAQCGCYDKDGNYYDVGARVPTAENCQSCNCTPSGIQCAHSLEACTCTYEDRTYSYQDVIYNTTDGLGACLIAICGSNGTIIRKAVACPGTPATTPFTFTTAWVPHSTTSPALPVSTVCVREVCRWSSWYNGHRPEPGLGGGDFETFENLRQRGYQVCPVLADIECRAAQLPDMPLEELGQQVDCDRMRGLMCANSQQSPPLCHDYELRVLCCEYVPCGPSPAPGTSPQPSLSASTEPAVPTPTQTTATEKTTLWVTPSIRSTAALTSQTGSSSGPVTVTPSAPGTTTCQPRCQWTEWFDEDYPKSEQLGGDVESYDKIRAAGGHLCQQPKDIECQAESFPNWTLAQVGQKVHCDVHFGLVCRNWEQEGVFKMCYNYRIRVLCCSDDHCRGRATTPPPTTELETATTTTTQALFSTPQPTSSPGLTRAPPASTTAVPTLSEGLTSPRYTSTLGTATTGGPTTPAGSTEPTVPGVATSTLPTRSALPGTTGSLGTWRPSQPPTLAPTTMATSRARPTGTASTASKEPLTTSLAPTLTSELSTSQAETSTPRTETTMSPLTNTTTSQGTTRCQPKCEWTEWFDVDFPTSGVAGGDMETFENIRAAGGKMCWAPKSIECRAENYPEVSIDQVGQVLTCSLETGLTCKNEDQTGRFNMCFNYNVRVLCCDDYSHCPSTPATSSTATPSSTPGTTWILTKPTTTATTTASTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTATATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSNTVTPSSALGTTHTPPVPNTMATTHGRSLPPSSPHTVRTAWTSATSGILGTTHITEPSTVTSHTLAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPSSIPGTTHTPTVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTRATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTEQTTAATTTATTGSTAIPSSTPGTAPPPKVLTSTATTPTATSSKATSSSSPRTATTLPVLTSTATKSTATSFTPIPSFTLGTTGTLPEQTTTPMATMSTIHPSSTPETTHTSTVLTTKATTTRATSSMSTPSSTPGTTWILTELTTAATTTAATGPTATPSSTPGTTWILTEPSTTATVTVPTGSTATASSTRATAGTLKVLTSTATTPTVISSRATPSSSPGTATALPALRSTATTPTATSVTAIPSSSLGTAWTRLSQTTTPTATMSTATPSSTPETVHTSTVLTTTTTTTRATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLPPSSPHTVRTAWTSATSGILGTTHITEPSTVTSHTPAATTSTTQHSTPALSSPHPSSRTTESPPSPGTTTPGHTRGTSRTTATATPSKTRTSTLLPSSPTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSVPGTTHTPTVLTTTTTTVATGSMATPSSSTQTSGTPPSLITTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATPSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPITPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 53325 - protein, 2439 aa, Homo sapiens
  Payload ID: 10600
  Gene Symbol: MUC6
  Gene Name: mucin 6, oligomeric mucus/gel-forming
  Uniprot ID: Q6W4X9
  ENSP ID: ENSP00000406861
MVQRWLLLSCCGALLSAGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARICTQLLTLVAPECSVSKEPFVLSCQADVAAAPQPGPQNSSCATLSEYSRQCSMVGQPVRRWRSPGLCSVGQCPANQVYQECGSACVKTCSNPQHSCSSSCTFGCFCPEGTVLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPAALERETDPCSMSQLNKVCAETHCSMLLRTGTVFERCHATVNPAPFYKRCVYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRPQMFLASCQAPKTFKSCSQSSENKFGAACAPTCQMLATGVACVPTKCEPGCVCAEGLYENADGQCVPPEECPCEFSGVSYPGGAELHTDCRTCSCSRGRWACQQGTHCPSTCTLYGEGHVITFDGQRFVFDGNCEYILATDVCGVNDSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMATSASNHSAPTGTIPPPTTLKATGSTHTAPPITPTTSGTSQAHSSFSTNKTPTSLHSHTSSTHHPEVTPTSTTTITPNPTSTRTRTPVAHTNSATSSRPPPPFTTHSPPTGSSPFSSTGPMTATSFKTTTTYPTPSHPQTTLPTHVPPFSTSLVTPSTHTVITPTHAQMATSASIHSMPTGTIPPPTTLKATGSTHTAPTMTLTTSGTSQALSSLNTAKTSTSLHSHTSSTHHAEATSTSTTNITPNPTSTGTPPMTVTTSGTSQSRSSFSTAKTSTSLHSHTSSTHHPEVTSTSTTSITPNHTSTGTRTPVAHTTSATSSRLPTPFTTHSPPTGTTPISSTGPVTATSFQTTTTYPTPSHPHTTLPTHVPSFSTSLVTPSTHTVIIPTHTQMATSASIHSMPTGTIPPPTTIKATGSTHTAPPMTPTTSGTSQSPSSFSTAKTSTSLPYHTSSTHHPEVTPTSTTNITPKHTSTGTRTPVAHTTSASSSRLPTPFTTHSPPTGSSPFSSTGPMTATSFQTTTTYPTPSHPQTTLPTHVPPFSTSLVTPSTHTVIITTHTQMATSASIHSTPTGTVPPPTTLKATGSTHTAPPMTVTTSGTSQTHSSFSTATASSSFISSSSWLPQNSSSRPPSSPITTQLPHLSSATTPVSTTNQLSSSFSPSPSAPSTVSSYVPSSHSSPQTSSPSVGTSSSFVSAPVHSTTLSSGSHSSLSTHPTTASVSASPLFPSSPAASTTIRATLPHTISSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGVCSVREQQEEITFKGCMANVTVTRCEGACISAASFNIITQQVDARCSCCRPLHSYEQQLELPCPDPSTPGRRLVLTLQVFSHCVCSSVACGD

SEQ ID NO: 53326 - protein, 219 aa, Homo sapiens
  Payload ID: 10600
  Gene Symbol: MUC6
  Gene Name: mucin 6, oligomeric mucus/gel-forming
  ENSP ID: ENSP00000433246
  MOD_RES (1)..(1): Any amino acid
XSSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGESTGGRPAPRPPRCSQPHPREVRAPHPGACCPISFNIITQQVDARCSCCRPLHSYEQQLELPCPDPSTPGRRLVLTLQVFSHCVCSS

SEQ ID NO: 53327 - protein, 181 aa, Homo sapiens
  Payload ID: 10600
  Gene Symbol: MUC6
  Gene Name: mucin 6, oligomeric mucus/gel-forming
  ENSP ID: ENSP00000433790
MDTSRTPSVCRETGGAALSRGERRPQGRRGSPTPTAGPVHTGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPD

SEQ ID NO: 53328 - protein, 115 aa, Homo sapiens
  Payload ID: 10600
  Gene Symbol: MUC6
  Gene Name: mucin 6, oligomeric mucus/gel-forming
  ENSP ID: ENSP00000436903
  MOD_RES (1)..(1): Any amino acid
XPPTTPQPPTTPQLPTTGSRPTQVWPMTGTSTTIGLLSSTGPSPSSNHTPASPTQTPLLPATLTSSKPTASSGGKEPPAEPMERAAAGGPRYTSGVGLGMALLPGSHLPLSRFPA

SEQ ID NO: 53329 - protein, 2439 aa, Homo sapiens
  Payload ID: 10600
  Gene Symbol: MUC6
  Gene Name: mucin 6, oligomeric mucus/gel-forming
  ENSP ID: ENSP00000480618
MVQRWLLLSCCGALLSAGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARICTQLLTLVAPECSVSKEPFVLSCQADVAAAPQPGPQNSSCATLSEYSRQCSMVGQPVRRWRSPGLCSVGQCPANQVYQECGSACVKTCSNPQHSCSSSCTFGCFCPEGTVLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPAALERETDPCSMSQLNKVCAETHCSMLLRTGTVFERCHATVNPAPFYKRCVYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRPQMFLASCQAPKTFKSCSQSSENKFGAACAPTCQMLATGVACVPTKCEPGCVCAEGLYENADGQCVPPEECPCEFSGVSYPGGAELHTDCRTCSCSRGRWACQQGTHCPSTCTLYGEGHVITFDGQRFVFDGNCEYILATDVCGVNDSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMATSASNHSAPTGTIPPPTTLKATGSTHTAPPITPTTSGTSQAHSSFSTNKTPTSLHSHTSSTHHPEVTPTSTTTITPNPTSTRTRTPVAHTNSATSSRPPPPFTTHSPPTGSSPFSSTGPMTATSFKTTTTYPTPSHPQTTLPTHVPPFSTSLVTPSTHTVITPTHAQMATSASIHSMPTGTIPPPTTLKATGSTHTAPTMTPTTSGTSQALSSLNTAKTSTSLHSHTSSTHHAEATSTSTTNITPNPTSTGTPPMTVTTSGTSQSRSSFSTAKTSTSLHSHTSSTHHPEVTSTSTTSITPNHTSTGTRTPVAHTTSATSSRLPTPFTTHSPPTGTTPISSTGPVTATSFQTTTTYPTPSHPHTTLPTHVPSFSTSLVTPSTHTVIIPTHTQMATSASIHSMPTGTIPPPTTIKATGSTHTAPPMTPTTSGTSQSPSSFSTAKTSTSLPYHTSSTHHPEVTPTSTTNITPKHTSTGTRTPVAHTTSASSSRLPTPFTTHSPPTGSSPFSSTGPMTATSFQTTTTYPTPSHPQTTLPTHVPPFSTSLVTPSTHTVIITTHTQMATSASIHSTPTGTVPPPTTLKATGSTHTAPPMTVTTSGTSQTHSSFSTATASSSFISSSSWLPQNSSSRPPSSPITTQLPHLSSATTPVSTTNQLSSSFSPSPSAPSTVSSYVPSSHSSPQTSSPSVGTSSSFVSAPVHSTTLSSGSHSSLSTHPTTASVSASPLFPSSPAASTTIRATLPHTISSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGVCSVREQQEEITFKGCMANVTVTRCEGACISAASFNIITQQVDARCSCCRPLHSYEQQLELPCPDPSTPGRRLVLTLQVFSHCVCSSVACGD

SEQ ID NO: 53330 - protein, 2439 aa, Homo sapiens
  Payload ID: 10600
  Gene Symbol: MUC6
  Gene Name: mucin 6, oligomeric mucus/gel-forming
  ENSP ID: ENSP00000481532
MVQRWLLLSCCGALLSAGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARICTQLLTLVAPECSVSKEPFVLSCQADVAAAPQPGPQNSSCATLSEYSRQCSMVGQPVRRWRSPGLCSVGQCPANQVYQECGSACVKTCSNPQHSCSSSCTFGCFCPEGTVLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPAALERETDPCSMSQLNKVCAETHCSMLLRTGTVFERCHATVNPAPFYKRCMYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRPQMFLASCQAPKTFKSCSQSSENKFGAACAPTCQMLATGVACVPTKCEPGCVCAEGLYENADGQCVPPEECPCEFSGVSYPGGAELHTDCRTCSCSRGRWACQQGTHCPSTCTLYGEGHVITFDGQRFVFDGNCEYILATDVCGVNDSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMATSASIHSAPTGTIPPPTTLKATGSTHTAPPITPTTSGTSQAHSSFSTNKTPTSLHSHTSSTHHPEVTPTSTTTITPNPTSTRTRTPVAHTNSATSSRPPPPFTTHSPPTGSSPFSSTGPMTATSFKTTTTYPTPSHPQTTLPTHVPPFSTSLVTPSTHTVITPTHAQMATSASIHSMPTGTIPPPTTLKATGSTHTAPTMTLTTSGTSQALSSLNTAKTSTSLHSHTSSTHHAEATSTSTTNITPNPTSTGTPPMTVTTSGTSQSRSSFSTAKTSTSLHSHTSSTHHPEVTSTSTTSITPNHTSTGTRTPVAHTTSATSSRLPTPFTTHSPPTGTTPISSTGPVTATSFQTTTTYPTPSHPHTTLPTHVPSFSTSLVTPSTHTVIIPTHTQMATSASIHSMPTGTIPPPTTIKATGSTHTAPPMTPTTSGTSQSPSSFSTAKTSTSLPYHTSSTHHPEVTPTSTTNITPKHTSTGTRTPVAHTTSASSSRLPTPFTTHSPPTGSSPFSSTGPMTATSFQTTTTYPTPSHPQTTLPTHVPPFSTSLVTPSTHTVIITTHTQMATSASIHSTPTGTVPPPTTLKATGSTHTAPPMTVTTSGTSQTHSSFSTATASSSFISSSSWLPQNSSSRPPSSPITTQLPHLSSATTPVSTTNQLSSSFSPSPSAPSTVSSYVPSSHSSPQTSSPSVGTSSSFVSAPVHSTTLSSGSHSSLSTHPTTASVSASPLFPSSPAASTTIRATLPHTISSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGVCSVREQQEEITFKGCMANVTVTRCEGACISAASFNIITQQVDARCSCCRPLHSYEQQLELPCPDPSTPGRRLVLTLQVFSHCVCSSVACGD

SEQ ID NO: 53331 - protein, 4029 aa, Homo sapiens
  Payload ID: 10600
  Gene Symbol: MUC6
  Gene Name: mucin 6, oligomeric mucus/gel-forming
  ENSP ID: ENSP00000486295
MVQRWLLLSCCGALLSAGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARICTQLLTLVAPECSVSKEPFVLSCQADVAAAPQPGPQNSSCATLSEYSRQCSMVGQPVRRWRSPGLCSVGQCPANQVYQECGSACVKTCSNPQHSCSSSCTFGCFCPEGTVLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPAALERETDPCSMSQLNKVCAETHCSMLLRTGTVFERCHATVNPAPFYKRCVYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRPQMFLASCQAPKTFKSCSQSSENKFGAACAPTCQMLATGVACVPTKCEPGCVCAEGLYENADGQCVPPEECPCEFSGVSYPGGAELHTDCRTCSCSRGRWACQQGTHCPSTCTLYGEGHVITFDGQRFVFDGNCEYILATDVCGVNDSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMATSASNHSAPTGTIPPPTTLKATGSTHTAPPITPTTSGTSQAHSSFSTNKTPTSLHSHTSSTHHPEVTPTSTTTITPNPTSTRTRTPVAHTNSATSSRPPPPFTTHSPPTGSSPFSSTGPMTATSFKTTTTYPTPSLPQTTLLTHVPPFSTSLVTPITHTVITPTHPQMSTSAYIHSTPTGTIAPPTTVKATRSTYTAPLMTATTSRISQAHSSISTAKTSTSLHSHASSTHHPEVTPTSTTNVTPKSTSRGTSTPVTHTTSATSSRPPTPITTHSSPTRSSPLSSTGRMTATSLKTTTTYPTPSQAHITLPIHVPPFSTSSVTPSTHTVITPTHPQMSTSASNHSTSTGTIPPLTTLTTTLHHTLPTYREQSPLSHRSYDSNILQDHHYLSNHITPSDHTSHSRSTFLQLVSDSKYSHSHHPYPCTDVHFCLDPLNANRYHSSTDNAHGHRVHTHSLTNDGDNHSDHPSPQLIQHSQNLYIHPLTCFLHTPSGNHTNFYHQHYSQVHCRNQHPCGPHHLGHQQQATHTLHHTLPTYREQSHLFHRSYDCNIHQDHHDLSNPITPSDHTYHSCSTFLHLISHSKYSHSHHPYPRTDVHFLHTLSSHPNFYHHHHPQPHQYRHQNPCGPHHLGHQQQATHTLHHTFPTYREQSHLFHRSYDCNILSDHHYLSNPITPSDHTSHSPSTFLHLLGDSKYSHSHHHYPHTDGHFCLHPLNANRHRSSTNNAQGHRVHPHSANNDADHQRDEPSPELIQHSQNLYIPTFTNFLHTPSSHPNFYRHHPQSHQYRNRHPCGPHHLSHQQQANHTLHHTLPTYREQSLLFHRSYDCNILPDHHYLSNTITPSDHTSHSRYIFLHLLGDSKYSHSHHPYPRTDGHLCVHPLNANRHHFSTNNAQGHRVLPLSPTNDVDHQWDQPIPKLIHGQNLYIPTFTHFLNTSSSHLNFYHQHHPQPHQYRHQNPCGPHHVGHQQQATHTLHHTLPTYREQSHLFHRSYDCKHPSRPPLPIQPHHTLTPHFPLTFHLSPPPWGLQVLTSSPLPTHRWPLLPPSTQCQQALFLHRPRSRPQGPPTQPHQRQPPVGPANPQAHLARPKLLHPYIHTFPQHIILKSPQLLPPPSPPTTPVQAPEPLWPTPPRPPAAGYPYPSPHIPHLQGAVPSLPQVLLQHPFRPPLPIQPHHTLTPHFPLTFHLSPPPWLQVLTSSPLPTHRWPLLPPSTQCQQALFLHRPRSRPQGPPTQPHQRQPPVGPANPQAHLARHWASTSLHSHIPPPTTVKATGTGSTHTAPRMTVTTSGTSQAHSSFSTAKTSTSLHSHASSTLHPEVTPTSTTTITPNPTNTGIRTPVANTTSATSSRLTTPFTTHSPPTGSSPISSTGPMTATSFQTTTTYPTPSHPQTTLPTHVPPFSTSLVTPSTHTVITPTHAQMATSASIHSTPTGTIPPPTTLKATGSTHTAPPMMPTTSGTSQASSSFNTAKTSTSLHSHTSSTHHPEVTPTSITNITLNPTSIGTWTPVAHTTSATSSRLTTPFTTHSPPTGTTPISSTGPVTATSFHATTTYPTPSHPQTTLPTHVPSFSTSLVTPSTHIVITPTHAQMATSASIHSMQTGTIPPPTTIKATGSTHTAPPMTPTTSGTSQSLSSFSTAKTSTSLPYHTSSTHHPEVTPTSTTNITPKHTSTGTRTPVAHTTSATSSRLPTPFTTHSPPTGSSPISSTGPMTAPSFQTTTTYPTPSHPQTTLPTHVPPFSTSLVTPSTHTVITPTHAQMATSASIHSMPTGTIPPPTTLKATGSTHTAPTMTPTTSGTSQALSSLNTAKTSTSLHSHTSSTHHAEATSTSTTNITPNPTSTGTPPMTVTTSGTSQSRSSFSTAKTSTSLHSHTSSTHHPEVTSTSTTSITPNHTSTGTRTPVAHTTSATSSRLPTPFTTHSPPTGTTPISSTGPVTATSFQTTTTYPTPSHPHTTLPTHVPSFSTSLVTPSTHTVIIPTHTQMATSASIHSMPTGTIPPPTTIKATGSTHTAPPMTPTTSGTSQSPSSFSTAKTSTSLPYHTSSTHHPEVTPTSTTNITPKHTSTGTRTPVAHTTSASSSRLPTPFTTHSPPTGSSPFSSTGPMTATSFQTTTTYPTPSHPQTTLPTHVPPFSTSLVTPSTHTVIITTHTQMATSASIHSTPTGTVPPPTTLKATGSTHTAPPMTVTTSGTSQTHSSFSTATASSSFISSSSWLPQNSSSRPPSSPITTQLPHLSSATTPVSTTNQLSSSFSPSPSAPSTVSSYVPSSHSSPQTSSPSVGTSSSFVSAPVHSTTLSSGSHSSLSTHPTTASVSASPLFPSSPAASTTIRATLPHTISSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGVCSVREQQEEITFKGCMANVTVTRCEGACISAASFNIITQQVDARCSCCRPLHSYEQQLELPCPDPSTPGRRLVLTLQVFSHCVCSSVACGD

SEQ ID NO: 53332 - protein, 4691 aa, Homo sapiens
  Payload ID: 10600
  Gene Symbol: MUC6
  Gene Name: mucin 6, oligomeric mucus/gel-forming
  ENSP ID: ENSP00000487059
MVQRWLLLSCCGALLSAGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARICTQLLTLVAPECSVSKEPFVLSCQADVAAAPQPGPQNSSCATLSEYSRQCSMVGQPVRRWRSPGLCSVGQCPANQVYQECGSACVKTCSNPQHSCSSSCTFGCFCPEGTVLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPAALERETDPCSMSQLNKVCAETHCSMLLRTGTVFERCHATVNPAPFYKRCMYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRPQMFLASCQAPKTFKSCSQSSENKFGAACAPTCQMLATGVACVPTKCEPGCVCAEGLYENADGQCVPPEECPCEFSGVSYPGGAELHTDCRTCSCSRGRWACQQGTHCPSTCTLYGEGHVITFDGQRFVFDGNCEYILATDVCGVNDSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMATSASIHSAPTGTIPPPTTLKATGSTHTAPPITPTTSGTSQAHSSFSTNKTPTSLHSHTSSTHHPEVTPTSTTTITPNPTSTRTRTPVAHTNSATSSRPPPPFTTHSPPTGSSPFSSTGPMTATSFKTTTTYPTPSLPQTTLLTHVPPFSTSLVTPITHTVITPTHPQMSTSAYIHSTPTGTIAPPTTVKATRSTYTAPLMTATTSRISQAHSSISTAKTSTSLHSHASSTHHPEVTPTSTTNVTPKSTSRGTSTPVTHTTSATSSRPPTPITTHSSPTRSSPLSSTGRMTATSLKTTTTYPTPSQAHITLPIHVPPFSTSSVTPSTHTVITPTHPQMSTSASNHSTSTGTIPPLTTLMATGSTHTAPLITVTTSRTSQVHSSFSTAKTSTSLLSHASSTHHPEITTNSTTTITPNPTSTGTGTPVAHTTSATSSRPPPPFTTHSPPTESSPLSPTGPMTPTSFKTTTTYPTTSHPQTTLPTHVPPFSSSSVTPSTHTVITPTHAQMSTSASIHSTPTGTIPPLTTLTATGSTHTASPMTGTTIRTTQAHSSFSIAKTSTSILSHASSTHHPETTPTSTTNITPKSTSAGTSTPVAHTTLATSSRPPTPFTTHSPPTGSSPISSTGPMTATSIKTTTTYPTPSHPQTTLTTHVPPFSTSSVTPSTHTVITPTHAQMSTSASIHSTPTGTVPPLTTRMPTGSTHTGPPMTGTIIQTSKAHNSFSTAKTSTSLHSHASSTHHPETTPTSTTNITPKPTSAGTSTPVAHTTLATSSRLPTTFTTHFPSTGSSPVSSTGPMTATSSQTTTTYPTPSHPQTTLPTHIPPFSTSLVTPSTHTVITPTRAQMSTSASIHSTPTGTIPPPTTLKATGTTHTHTTRTMTVTTTSQALRSLYIGTASTSIPLHSHASSHLRTRHFYYHHHHPQPHQYRNPTNDSDHQWDQPIPKLIHGQNLYIPTFTHFLHTPSSHLNFYHQHHPQPHQYRHQNPCGPHHVGHQQQATHTLHHTLPTYRDHSHLFHRSCHCNILPDHHYRSNPITPSHHTSHSRSIFLHLLGDSKYSHSHHPYPRTDGHFCLHPLNANRHYSSTDHDQGHRVHPHSPTNDGNHQWDQPIPKLIHGQNFYIPTFTHFLNTSSSHPNFYHHHHPQPHQYRHQNPCGPHHLGHQQQATHTLHHTFPTYREQSHLFHRSYDCNILSDHHYLSNPITPSDHTSHSHSTFLHLLGDSKYSHSHHHYPHTDGHFCLHPLNANRHRSSTNNAQGHRVHPHSANNDADHQRDEPSPELIQHSQNLYIPTFTNFLHTPSSHPNFYRHHPQSHQSRNRHPCGPHHLSHQQQANHTLHHTLLTYREQSLLFHRSYDCNILPDHHYLSNPITPSDHTSHSRSTFLHLFGDSKYSHSHHPYPCTDGHFCLHPLNANRHDSSTDNAQGHRVHPHSANNDADHQRDQPSPELIKHSQNLYIPTFTHFLHTPCSHLNFYHQHHPQPHQYRNWGACGPHHLSHQQQANPALHHTLPTYRVTTLKATGSIHTAPPMTPTTSGTSQSPSSFSMAKTSTSLPYHTSSTHHPEVTPTSTTNITPKHTSTGTRTPVAHTTSATSSKLPTPFTTHSPPTGSSPISSTGPVTATSFQTTTTYPTPSHSHTTLPTHVPPSSTSLVTPNTHTVITHTHAQMSTSASIHSTPTGTIPPPTTLKATGSTHTAPPMTPTTSGTRQAPSSFSTAKTSTSLHSHTSSTHHPAVTPTSTTTITPNHTSTGTRTPVAHTTSATSSRLPTPFTTHSPPTGSSPISSTAPCHCNILPDHHYPIQPTSQSQYHTSHSHSTFLHLLGDSKYTHSHHPNFYHHHPQSHQYRNRHPCGPHHLSHQQQANHTLHHTLPTYREQSHLFHRSCHCNILPCHHYLSNTITPSDHTSHSRSIFLHLLGDSKYSHSHHPYPRTDDHFCLHPLNANRHHSSTDNAEGHRVHPHSPTNDANHQWDQPSLKLIQHSQNLYIPTFTHFLHTPSSHPNFYHQHHPQPHQYRNLDTRGPHHLSHQQQANHTLHHTLPTYRDHSHLFHRSCHCNILPCHHYLSNTITPSDHTSHSRSIFLHLLGDSKYSHSHHPYPRTDGHFCLHPLNANRHHSSTDHDQGHRVHPHSPTNDTDHQWDQPIPKLIHGQNFYIPTLPHFLHTPSSHPNFYHQHHPQTHQYRHQNPCGPHHLGHQQQTTHTLHHTFPTYREQSHLFHRSYDCTILSDHHYLSNPITPSDHTSHSHSTFLHLLGDSKYSQGHHPYPCTDVHFCLHPLNANRHHSSTNNAQGHRVHPHSPTNHSDHQWDQPIRKLIHRQNLYILTFTHFLHTLSSHPNFYHHHHPQPHQYRHQNPCGPHHLGHQQQATHTLHHTFPTYREQSHLFHRSYDCNILPDHHYLSNPITPSDHTSHSRSTFLHLFGDSKYSHSHHPYPCTDGHFCLHPLNANRHDSSTDNAQGHRVHPHSANNDADHQRDQPSPELIKHSQNLYIPTFTHFLHTPCSHLNFYHQHHPQPHQYRNPTNDSDHQWDQPIPKLIHGQNLYIPTFTHFLHTPSSHLNFYHQHHPQPHQYRHQNPCGPHHVGHQQQATHTLHHTLPTYRDHSHLFHRSCHCNILPDHHYLSNPITPSHHTSHSRSIFLHLLGDSKYSHGHHPYPHTDGHFCLHPLNANRHHSSTDHDQGHRVHPHSPTNDTDHQWDQPIPKLIHGQNFYIPTLPHFLNTPSSHPNFYHQHHPQTHQYRHQNPCGPHHLGQQQQATHTLHHTLPTYREQSLLFHRSYDCNILPDHHYLSNPITPSDHTSHSRSTFLHLLGDSKYSHSHHHYPHTDGHFCLHPLNANRHRSSTNNAQGHRVHPHSPTNDSDHQWDQPNPQLIQHSYSLFFLHILLVLAASELLKATVITYHHTTPPLEFCNHSCFHNSAVLLIFSQSFCPLYCFFLCALLPLLSPDFIAFCWHIFLFRVRPRALHNPELGVTLLIVHSSHDCISVCISSFSFFSSCLYYHGHSPPHYLLSFHPLCSTPHIHCYRVSHPIQPPSLQHHCISVHAQDHGQHPHRPCLLLSVHHLAVHFSHHPSSHIRLCVTHLGGDGYPHLSSHQPYHQAPWSHLVAYHTVPDQLPHCPWKHPCFCPGIFSRDTYAHLTRGLQCAGAAGGDHVQGVHGERDGNPLGRLHFRCQLQHHHPAGGCPLQLLPPPPLLAAAGAALPRSQHAWPAARTHPAGVQPLRVQLCGLWRL

SEQ ID NO: 53333 - protein, 377 aa, Homo sapiens
  Payload ID: 10601
  Gene Symbol: MUC7
  Gene Name: mucin 7, secreted
  Uniprot ID: Q8TAX7
  ENSP ID: ENSP00000302021
MKTLPLFVCICALSACFSFSEGRERDHELRHRRHHHQSPKSHFELPHYPGLLAHQKPFIRKSYKCLHKRCRPKLPPSPNNPPKFPNPHQPPKHPDKNSSVVNPTLVATTQIPSVTFPSASTKITTLPNVTFLPQNATTISSRENVNTSSSVATLAPVNSPAPQDTTAAPPTPSATTPAPPSSSAPPETTAAPPTPSATTQAPPSSSAPPETTAAPPTPPATTPAPPSSSAPPETTAAPPTPSATTPAPLSSSAPPETTAVPPTPSATTLDPSSASAPPETTAAPPTPSATTPAPPSSPAPQETTAAPITTPNSSPTTLAPDTSETSAAPTHQTTTSVTTQTTTTKQPTSAPGQNKISRFLLYMKNLLNRIIDDMVEQ

SEQ ID NO: 53334 - protein, 377 aa, Homo sapiens; identical to SEQ ID NO: 53333
  Payload ID: 10601
  Gene Symbol: MUC7
  Gene Name: mucin 7, secreted
  Uniprot ID: Q8TAX7
  ENSP ID: ENSP00000400585

SEQ ID NO: 53335 - protein, 377 aa, Homo sapiens; identical to SEQ ID NO: 53333
  Payload ID: 10601
  Gene Symbol: MUC7
  Gene Name: mucin 7, secreted
  Uniprot ID: Q8TAX7
  ENSP ID: ENSP00000407422

SEQ ID NO: 53336 - protein, 136 aa, Homo sapiens
  Payload ID: 10601
  Gene Symbol: MUC7
  Gene Name: mucin 7, secreted
  ENSP ID: ENSP00000427594
MKTLPLFVCICALSACFSFSEGRERDHELRHRRHHHQSPKSHFELPHYPGLLAHQKPFIRKSYKCLHKRCRPKLPPSPNNPPKFPNPHQPPKHPDKNSSVVNPTLVATTQIPSVTFPSASTKITTLPNVTFLPQNA

SEQ ID NO: 53337 - protein, 90 aa, Homo sapiens
  Payload ID: 10602
  Gene Symbol: MUCL1
  Gene Name: mucin-like 1
  Uniprot ID: Q96DR8
  ENSP ID: ENSP00000311364
MKFLAVLVLLGVSIFLVSAQNPTTAAPADTYPATGPADDEAPDAETTAAATTATTAAPTTATTAASTTARKDIPVLPKWVGDLPNGRVCP

SEQ ID NO: 53338 - protein, 85 aa, Homo sapiens
  Payload ID: 10602
  Gene Symbol: MUCL1
  Gene Name: mucin-like 1
  ENSP ID: ENSP00000449369
MGGDHGYQLAVTKAENPTTAAPADTYPATGPADDEAPDAETTAAATTATTAAPTTATTAASTTARKDIPVLPKWVGDLPNGRVCP

SEQ ID NO: 53339 - protein, 80 aa, Homo sapiens
  Payload ID: 10602
  Gene Symbol: MUCL1
  Gene Name: mucin-like 1
  ENSP ID: ENSP00000480191
MKFLAVLVLLGVSIFLVSAQNPTTAAPADTYPATGPADDEAPDAETTPTTATTAASTTARKDIPVLPKWVGDLPNGRVCP

SEQ ID NO: 53340 - protein, 580 aa, Homo sapiens
  Payload ID: 10603
  Gene Symbol: MCOLN1
  Gene Name: mucolipin 1
  Uniprot ID: Q9GZU1
  ENSP ID: ENSP00000264079
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTDCIQVDPPERPPPPPSDDLTLLESSSSYKNLTLKFHKLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 53341 - protein, 200 aa, Homo sapiens
  Payload ID: 10603
  Gene Symbol: MCOLN1
  Gene Name: mucolipin 1
  ENSP ID: ENSP00000469074
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTGWSMSPSTSG

SEQ ID NO: 53342 - protein, 182 aa, Homo sapiens
  Payload ID: 10603
  Gene Symbol: MCOLN1
  Gene Name: mucolipin 1
  ENSP ID: ENSP00000472176
  MOD_RES (1)..(1): Any amino acid
XEAKNLASYDVCSILLGTSTLLVWVGVIRYLTFFHNYNILIATLRVALPSVMRFCCCVAVIYLGYCFCGWIVLGPYHVKPLHLHGAQPLHRAHHRRLRHHQASRRRRRRGERAAGLHRTVPGQPHLRQVPPRERLGLQPSLLLRKGPLGGAFAAGELIRPDCRWTVGPGLQRPPPPTPLIYL

SEQ ID NO: 53343 - protein, 538 aa, Homo sapiens
  Payload ID: 10604
  Gene Symbol: MCOLN2
  Gene Name: mucolipin 2
  Uniprot ID: Q8IZK6
  ENSP ID: ENSP00000284027
MAHRDSEMKEECLREDLKFYFMSPCEKYRARRQIPWKLGLQILKIVMVTTQLVRFGLSNQLVVAFKEDNTVAFKHLFLKGYSGTDEDDYSCSVYTQEDAYESIFFAINQYHQLKDITLGTLGYGENEDNRIGLKVCKQHYKKGTMFPSNETLNIDNDVELDCVQLDLQDLSKKPPDWKNSSFFRLEFYRLLQVEISFHLKGIDLQTIHSRELPDCYVFQNTIIFDNKAHSGKIKIYFDSDAKIEECKDLNIFGSTQKNAQYVLVFDAFVIVICLASLILCTRSIVLALRLRKRFLNFFLEKYKRPVCDTDQWEFINGWYVLVIISDLMTIIGSILKMEIKAKNLTNYDLCSIFLGTSTLLVWVGVIRYLGYFQAYNVLILTMQASLPKVLRFCACAGMIYLGYTFCGWIVLGPYHDKFENLNTVAECLFSLVNGDDMFATFAQIQQKSILVWLFSRLYLYSFISLFIYMILSLFIALITDSYDTIKKFQQNGFPETDLQEFLKECSSKEEYQKESSAFLSCICCRRRKRSDDHLIPIS

SEQ ID NO: 53344 - protein, 566 aa, Homo sapiens
  Payload ID: 10604
  Gene Symbol: MCOLN2
  Gene Name: mucolipin 2
  Uniprot ID: Q8IZK6
  ENSP ID: ENSP00000359640
MARQPYRFPQARIPERGSGVFRLTVRNAMAHRDSEMKEECLREDLKFYFMSPCEKYRARRQIPWKLGLQILKIVMVTTQLVRFGLSNQLVVAFKEDNTVAFKHLFLKGYSGTDEDDYSCSVYTQEDAYESIFFAINQYHQLKDITLGTLGYGENEDNRIGLKVCKQHYKKGTMFPSNETLNIDNDVELDCVQLDLQDLSKKPPDWKNSSFFRLEFYRLLQVEISFHLKGIDLQTIHSRELPDCYVFQNTIIFDNKAHSGKIKIYFDSDAKIEECKDLNIFGSTQKNAQYVLVFDAFVIVICLASLILCTRSIVLALRLRKRFLNFFLEKYKRPVCDTDQWEFINGWYVLVIISDLMTIIGSILKMEIKAKNLTNYDLCSIFLGTSTLLVWVGVIRYLGYFQAYNVLILTMQASLPKVLRFCACAGMIYLGYTFCGWIVLGPYHDKFENLNTVAECLFSLVNGDDMFATFAQIQQKSILVWLFSRLYLYSFISLFIYMILSLFIALITDSYDTIKKFQQNGFPETDLQEFLKECSSKEEYQKESSAFLSCICCRRRKRSDDHLIPIS

SEQ ID NO: 53345 - protein, 249 aa, Homo sapiens
  Payload ID: 10604
  Gene Symbol: MCOLN2
  Gene Name: mucolipin 2
  ENSP ID: ENSP00000436299
MARQPYRFPQARIPERGSGVFRLTVRNAMAHRDSEMKEECLREDLKFYFMSPCEKYRARRQIPWKLGLQILKIVMVTTQLVRFGLSNQLVVAFKEDNTVAFKHLFLKGYSGTDEDDYSCSVYTQEDAYESIFFAINQYHQLKDITLGTLGYGENEDNRIGLKVCKQHYKKGTMFPSNETLNIDNDVELDCVQLDLQDLSKKPPDWKNSSFFRLEFYRLLQVEISFHLKGIDLQTIHSRELPDCYVFQNT

SEQ ID NO: 53346 - protein, 497 aa, Homo sapiens
  Payload ID: 10605
  Gene Symbol: MCOLN3
  Gene Name: mucolipin 3
  Uniprot ID: Q8TDD5
  ENSP ID: ENSP00000342698
MADPEVVVSSCSSHEEENRCNFNQQTSPSEELLLEDQMRRKLKFFFMNPCEKFWARGRKPWKLAIQILKIAMVTIQYLQLYNVSVGNHAYENKGTKQSAMAICQHFYKRGNIYPGNDTFDIDPEIETECFFVEPDEPFHIGTPAENKLNLTLDFHRLLTVELQFKLKAINLQTVRHQELPDCYDFTLTITFDNKAHSGRIKISLDNDISIRECKDWHVSGSIQKNTHYMMIFDAFVILTCLVSLILCIRSVIRGLQLQQEFVNFFLLHYKKEVSVSDQMEFVNGWYIMIIISDILTIIGSILKMEIQAKSLTSYDVCSILLGTSTMLVWLGVIRYLGFFAKYNLLILTLQAALPNVIRFCCCAAMIYLGYCFCGWIVLGPYHDKFRSLNMVSECLFSLINGDDMFATFAKMQQKSYLVWLFSRIYLYSFISLFIYMILSLFIALITDTYETIKQYQQDGFPETELRTFISECKDLPNSGKYRLEDDPPVSLFCCCKK

SEQ ID NO: 53347 - protein, 321 aa, Homo sapiens
  Payload ID: 10605
  Gene Symbol: MCOLN3
  Gene Name: mucolipin 3
  ENSP ID: ENSP00000359619
MADPEVVVSSCSSHEEENRCNFNQQTSPSEELLLEDQMRRKLKFFFMNPCEKFWARGRKPWKLAIQILKIAMVTIQLVLFGLSNQMVVAFKEENTIAFKHLFLKGYMDRMDDTYAVYTQSDVYDQLIFAVNQYLQLYNVSVGNHAYENKGTKQSAMAICQHFYKRGNIYPGNDTFDIDPEIETECFFVEPDEPFHIGTPAENKLNLTLDFHRLLTVELQFKLKAINLQTVRHQELPDCYDFTLTITFDNKAHSGRIKISLDNDISIRECKDWHVSGSIQKNTHYMMIFDAFVILTCLVSLILCIRSVIRGLQLQQVGNVAF

SEQ ID NO: 53348 - protein, 553 aa, Homo sapiens
  Payload ID: 10605
  Gene Symbol: MCOLN3
  Gene Name: mucolipin 3
  Uniprot ID: Q8TDD5
  ENSP ID: ENSP00000359621
MADPEVVVSSCSSHEEENRCNFNQQTSPSEELLLEDQMRRKLKFFFMNPCEKFWARGRKPWKLAIQILKIAMVTIQLVLFGLSNQMVVAFKEENTIAFKHLFLKGYMDRMDDTYAVYTQSDVYDQLIFAVNQYLQLYNVSVGNHAYENKGTKQSAMAICQHFYKRGNIYPGNDTFDIDPEIETECFFVEPDEPFHIGTPAENKLNLTLDFHRLLTVELQFKLKAINLQTVRHQELPDCYDFTLTITFDNKAHSGRIKISLDNDISIRECKDWHVSGSIQKNTHYMMIFDAFVILTCLVSLILCIRSVIRGLQLQQEFVNFFLLHYKKEVSVSDQMEFVNGWYIMIIISDILTIIGSILKMEIQAKSLTSYDVCSILLGTSTMLVWLGVIRYLGFFAKYNLLILTLQAALPNVIRFCCCAAMIYLGYCFCGWIVLGPYHDKFRSLNMVSECLFSLINGDDMFATFAKMQQKSYLVWLFSRIYLYSFISLFIYMILSLFIALITDTYETIKQYQQDGFPETELRTFISECKDLPNSGKYRLEDDPPVSLFCCCKK

SEQ ID NO: 53349 - protein, 141 aa, Homo sapiens
  Payload ID: 10605
  Gene Symbol: MCOLN3
  Gene Name: mucolipin 3
  ENSP ID: ENSP00000474024
MADPEVVVSSCSSHEEENRCNFNQQTSPSEELLLEDQMRRKLKFFFMNPCEKFWARGRKPWKLAIQILKIAMVTIQLVLFGLSNQMVVAFKEENTIAFKHLFLKGYMDRMDDTYAVYTQSDVYDQLIFAVNQGNDKCYEEK

SEQ ID NO: 53350 - protein, 382 aa, Homo sapiens
  Payload ID: 10606
  Gene Symbol: MADCAM1
  Gene Name: mucosal vascular addressin cell adhesion molecule 1
  Uniprot ID: Q13477
  ENSP ID: ENSP00000215637
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPVLHSPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 53351 - protein, 295 aa, Homo sapiens
  Payload ID: 10606
  Gene Symbol: MADCAM1
  Gene Name: mucosal vascular addressin cell adhesion molecule 1
  Uniprot ID: Q13477
  ENSP ID: ENSP00000304247
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPASKPAGDQLPAALWTSSAVLGLLLLALPTYHLWKRCRHLAEDDTHPPASLRLLPQVSAWAGLRGTGQVGISPS

SEQ ID NO: 53352 - protein, 200 aa, Homo sapiens
  Payload ID: 10606
  Gene Symbol: MADCAM1
  Gene Name: mucosal vascular addressin cell adhesion molecule 1
  Uniprot ID: Q13477
  ENSP ID: ENSP00000372130
MDFGLALLLAGLLGLLLAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPASKPAGDQLPAALWTSSAVLGLLLLALPTYHLWKRCRHLAEDDTHPPASLRLLPQVSAWAGLRGTGQVGISPS

SEQ ID NO: 53353 - protein, 163 aa, Homo sapiens
  Payload ID: 10606
  Gene Symbol: MADCAM1
  Gene Name: mucosal vascular addressin cell adhesion molecule 1
  ENSP ID: ENSP00000475575
MGGILHSPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 53354 - protein, 390 aa, Homo sapiens
  Payload ID: 10606
  Gene Symbol: MADCAM1
  Gene Name: mucosal vascular addressin cell adhesion molecule 1
  ENSP ID: ENSP00000480104
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPALHALSNPEAPAPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 53355 - protein, 406 aa, Homo sapiens
  Payload ID: 10606
  Gene Symbol: MADCAM1
  Gene Name: mucosal vascular addressin cell adhesion molecule 1
  ENSP ID: ENSP00000480908
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPALHALSNPEAPAAESPQAPSLSTPASSHPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 53356 - protein, 400 aa, Homo sapiens
  Payload ID: 10606
  Gene Symbol: MADCAM1
  Gene Name: mucosal vascular addressin cell adhesion molecule 1
  ENSP ID: ENSP00000483663
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPVRWVPWRPTRSPALTSTSESHSPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 53357 - protein, 398 aa, Homo sapiens
  Payload ID: 10606
  Gene Symbol: MADCAM1
  Gene Name: mucosal vascular addressin cell adhesion molecule 1
  ENSP ID: ENSP00000484153
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPALHGWLSPPPPQNTGPHGPHPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 53358 - protein, 400 aa, Homo sapiens
  Payload ID: 10606
  Gene Symbol: MADCAM1
  Gene Name: mucosal vascular addressin cell adhesion molecule 1
  ENSP ID: ENSP00000484317
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPVRWVPWRPTRSPADSTSPVLHSPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 53359 - protein, 179 aa, Homo sapiens
  Payload ID: 10607
  Gene Symbol: MCIDAS
  Gene Name: multiciliate differentiation and DNA synthesis associated cell cycle protein
  ENSP ID: ENSP00000422165
MQACGGGAAGRRAFDSICPNRMLALPGRALLCKPGKPERKFAPPRKFFPGCTGGSPVSVYEDPPDAEPTALPALTTIDLQDLADCSSLLGSDAPPGGDLAASQNHSHQTEADFNLQDFRDTVDDLISGKLILYDVAYPGQRRLPLLSLRHITIRALPLPATGPTGPAVTTAAPSRRAPA

SEQ ID NO: 53360 - protein, 385 aa, Homo sapiens
  Payload ID: 10607
  Gene Symbol: MCIDAS
  Gene Name: multiciliate differentiation and DNA synthesis associated cell cycle protein
  Uniprot ID: D6RGH6
  ENSP ID: ENSP00000426359
MQACGGGAAGRRAFDSICPNRMLALPGRALLCKPGKPERKFAPPRKFFPGCTGGSPVSVYEDPPDAEPTALPALTTIDLQDLADCSSLLGSDAPPGGDLAASQNHSHQTEADFNLQDFRDTVDDLISDSSSMMSPTLASGDFPFSPCDISPFGPCLSPPLDPRALQSPPLRPPDVPPPEQYWKEVADQNQRALGDALVENNQLHVTLTQKQEEIASLKERNVQLKELASRTRHLASVLDKLMITQSRDCGAAAEPFLLKAKAKRSLEELVSAAGQDCAEVDAILREISERCDEALQSRDPKRPRLLPEPANTDTRPGNLHGAFRGLRTDCSRSALNLSHSELEEGGSFSTRIRSHSTIRTLAFPQGNAFTIRTANGGYKFRWVPS

SEQ ID NO: 53361 - protein, 1228 aa, Homo sapiens
  Payload ID: 10608
  Gene Symbol: MMRN1
  Gene Name: multimerin 1
  Uniprot ID: Q13201
  ENSP ID: ENSP00000264790
MKGARLFVLLSSLWSGGIGLNNSKHSWTIPEDGNSQKTMPSASVPPNKIQSLQILPTTRVMSAEIATTPEARTSEDSLLKSTLPPSETSAPAEGVRNQTLTSTEKAEGVVKLQNLTLPTNASIKFNPGAESVVLSNSTLKFLQSFARKSNEQATSLNTVGGTGGIGGVGGTGGVGNRAPRETYLSRGDSSSSQRTDYQKSNFETTRGKNWCAYVHTRLSPTVILDNQVTYVPGGKGPCGWTGGSCPQRSQKISNPVYRMQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGLKSKSINVLIRDIVREQFKIFQNDMQETVAQLFKTVSSLSEDLESTRQIIQKVNESVVSIAAQQKFVLVQENRPTLTDIVELRNHIVNVRQEMTLTCEKPIKELEVKQTHLEGALEQEHSRSILYYESLNKTLSKLKEVHEQLLSTEQVSDQKNAPAAESVSNNVTEYMSTLHENIKKQSLMMLQMFEDLHIQESKINNLTVSLEMEKESLRGECEDMLSKCRNDFKFQLKDTEENLHVLNQTLAEVLFPMDNKMDKMSEQLNDLTYDMEILQPLLEQGASLRQTMTYEQPKEAIVIRKKIENLTSAVNSLNFIIKELTKRHNLLRNEVQGRDDALERRINEYALEMEDGLNKTMTIINNAIDFIQDNYALKETLSTIKDNSEIHHKCTSDMETILTFIPQFHRLNDSIQTLVNDNQRYNFVLQVAKTLAGIPRDEKLNQSNFQKMYQMFNETTSQVRKYQQNMSHLEEKLLLTTKISKNFETRLQDIESKVTQTLIPYYISVKKGSVVTNERDQALQLQVLNSRFKALEAKSIHLSINFFSLNKTLHEVLTMCHNASTSVSELNATIPKWIKHSLPDIQLLQKGLTEFVEPIIQIKTQAALSNLTCCIDRSLPGSLANVVKSQKQVKSLPKKINALKKPTVNLTTVLIGRTQRNTDNIIYPEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 53362 - protein, 1228 aa, Homo sapiens; identical to SEQ ID NO: 53361
  Payload ID: 10608
  Gene Symbol: MMRN1
  Gene Name: multimerin 1
  Uniprot ID: Q13201
  ENSP ID: ENSP00000378431

SEQ ID NO: 53363 - protein, 970 aa, Homo sapiens
  Payload ID: 10608
  Gene Symbol: MMRN1
  Gene Name: multimerin 1
  ENSP ID: ENSP00000426461
MQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGLKSKSINVLIRDIVREQFKIFQNDMQETVAQLFKTVSSLSEDLESTRQIIQKVNESVVSIAAQQKFVLVQENRPTLTDIVELRNHIVNVRQEMTLTCEKPIKELEVKQTHLEGALEQEHSRSILYYESLNKTLSKLKEVHEQLLSTEQVSDQKNAPAAESVSNNVTEYMSTLHENIKKQSLMMLQMFEDLHIQESKINNLTVSLEMEKESLRGECEDMLSKCRNDFKFQLKDTEENLHVLNQTLAEVLFPMDNKMDKMSEQLNDLTYDMEILQPLLEQGASLRQTMTYEQPKEAIVIRKKIENLTSAVNSLNFIIKELTKRHNLLRNEVQGRDDALERRINEYALEMEDGLNKTMTIINNAIDFIQDNYALKETLSTIKDNSEIHHKCTSDMETILTFIPQFHRLNDSIQTLVNDNQRYNFVLQVAKTLAGIPRDEKLNQSNFQKMYQMFNETTSQVRKYQQNMSHLEEKLLLTTKISKNFETRLQDIESKVTQTLIPYYISVKKGSVVTNERDQALQLQVLNSRFKALEAKSIHLSINFFSLNKTLHEVLTMCHNASTSVSELNATIPKWIKHSLPDIQLLQKGLTEFVEPIIQIKTQAALSNLTCCIDRSLPGSLANVVKSQKQVKSLPKKINALKKPTVNLTTVLIGRTQRNTDNIIYPEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 53364 - protein, 949 aa, Homo sapiens
  Payload ID: 10609
  Gene Symbol: MMRN2
  Gene Name: multimerin 2
  Uniprot ID: Q9H8L6
  ENSP ID: ENSP00000361097
MILSLLFSLGGPLGWGLLGAWAQASSTSLSDLQSSRTPGVWKAEAEDTGKDPVGRNWCPYPMSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFTLHRSISELQADVDTKLKRLHKAQEAPGTNGSLVLATPGAGARPEPDSLQARLGQLQRNLSELHMTTARREEELQYTLEDMRATLTRHVDEIKELYSESDETFDQISKVERQVEELQVNHTALRELRVILMEKSLIMEENKEEVERQLLELNLTLQHLQGGHADLIKYVKDCNCQKLYLDLDVIREGQRDATRALEETQVSLDERRQLDGSSLQALQNAVDAVSLAVDAHKAEGERARAATSRLRSQVQALDDEVGALKAAAAEARHEVRQLHSAFAALLEDALRHEAVLAALFGEEVLEEMSEQTPGPLPLSYEQIRVALQDAASGLQEQALGWDELAARVTALEQASEPPRPAEHLEPSHDAGREEAATTALAGLARELQSLSNDVKNVGRCCEAEAGAGAASLNASLHGLHNALFATQRSLEQHQRLFHSLFGNFQGLMEANVSLDLGKLQTMLSRKGKKQQKDLEAPRKRDKKEAEPLVDIRVTGPVPGALGAALWEAGSPVAFYASFSEGTAALQTVKFNTTYINIGSSYFPEHGYFRAPERGVYLFAVSVEFGPGPGTGQLVFGGHHRTPVCTTGQGSGSTATVFAMAELQKGERVWFELTQGSITKRSLSGTAFGGFLMFKT

SEQ ID NO: 53365 - protein, 123 aa, Homo sapiens
  Payload ID: 10609
  Gene Symbol: MMRN2
  Gene Name: multimerin 2
  ENSP ID: ENSP00000473405
MSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDL

SEQ ID NO: 53366 - protein, 109 aa, Homo sapiens
  Payload ID: 10609
  Gene Symbol: MMRN2
  Gene Name: multimerin 2
  ENSP ID: ENSP00000476355
MILSLLFSLGGPLGWGLLGAWAQASSTSLSDLQSSRTPGVWKAEAEDTGKDPVGRIMDSRIPALLRQEARTGGSALAPPVDLGVAQQPSPLACFPVTGAPTQCPSWSPY

SEQ ID NO: 53367 - protein, 204 aa, Homo sapiens
  Payload ID: 10609
  Gene Symbol: MMRN2
  Gene Name: multimerin 2
  ENSP ID: ENSP00000476378
MAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRV

SEQ ID NO: 53368 - protein, 295 aa, Homo sapiens
  Payload ID: 10609
  Gene Symbol: MMRN2
  Gene Name: multimerin 2
  ENSP ID: ENSP00000477052
MGTSASWAGGMGIKGQPEAAKSWRKPKQSNWCPYPMSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFT

SEQ ID NO: 53369 - protein, 778 aa, Homo sapiens
  Payload ID: 10610
  Gene Symbol: MCTP1
  Gene Name: multiple C2 domains, transmembrane 1
  Uniprot ID: Q6DN14
  ENSP ID: ENSP00000308957
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 53370 - protein, 692 aa, Homo sapiens
  Payload ID: 10610
  Gene Symbol: MCTP1
  Gene Name: multiple C2 domains, transmembrane 1
  Uniprot ID: Q6DN14
  ENSP ID: ENSP00000391639
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 53371 - protein, 169 aa, Homo sapiens
  Payload ID: 10610
  Gene Symbol: MCTP1
  Gene Name: multiple C2 domains, transmembrane 1
  ENSP ID: ENSP00000421543
KIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKVILSL

SEQ ID NO: 53372 - protein, 135 aa, Homo sapiens
  Payload ID: 10610
  Gene Symbol: MCTP1
  Gene Name: multiple C2 domains, transmembrane 1
  ENSP ID: ENSP00000422219
MLDSCKLKSACNLPFICNKTLYGKIGKDRLNAVNKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMG

SEQ ID NO: 53373 - protein, 81 aa, Homo sapiens
  Payload ID: 10610
  Gene Symbol: MCTP1
  Gene Name: multiple C2 domains, transmembrane 1
  ENSP ID: ENSP00000422317
MLDSCKLKSACNLPFICNKKIINTAGTSNAEVPLADPGMYQLDITLRRGQSLAARDRGGTSDPYVKFKIGGKEVFRSKIIH

SEQ ID NO: 53374 - protein, 683 aa, Homo sapiens
  Payload ID: 10610
  Gene Symbol: MCTP1
  Gene Name: multiple C2 domains, transmembrane 1
  ENSP ID: ENSP00000423410
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNEL

SEQ ID NO: 53375 - protein, 999 aa, Homo sapiens
  Payload ID: 10610
  Gene Symbol: MCTP1
  Gene Name: multiple C2 domains, transmembrane 1
  Uniprot ID: Q6DN14
  ENSP ID: ENSP00000424126
MEPRAAAAGEPEPPAASSSFQARLWKNLQLGVGRSKGGGGGRAGGPERRTADTPSPSPPPPVGTGNAPARGSGAGSRWSGFKKRKQVLDRVFSSSQPNLCCSSPEPLEPGGAGRAEQGSTLRRRIREHLLPAVKGPAAASGAAGGTPPGGRSPDSAPSSSSASSSLSSSPQPPPRGDRARDEGARRQGPGAHLCHQKSSSLPGTACLEQLLEPPPPPAEPARSPAESRAPETGEEHGSSQKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 53376 - protein, 191 aa, Homo sapiens
  Payload ID: 10610
  Gene Symbol: MCTP1
  Gene Name: multiple C2 domains, transmembrane 1
  ENSP ID: ENSP00000424936
QKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVFQTQSLRLSDLHRKSHLWRGIVSITLIEGRDLKAMDSNG

SEQ ID NO: 53377 - protein, 292 aa, Homo sapiens
  Payload ID: 10610
  Gene Symbol: MCTP1
  Gene Name: multiple C2 domains, transmembrane 1
  ENSP ID: ENSP00000425515
  MOD_RES (1)..(1): Any amino acid
XLCHQKSSSLPGTACLEQLLEPPPPPAEPARSPAESRAPETGEEHGSSQKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKFQTQSLRLSDLHRKSHLWRGIVSITLIEGRDLKAMDSNGLSDPYVKFRLGHQKYKSKIMPKTLNPQWREQFDFHLYEER

SEQ ID NO: 53378 - protein, 414 aa, Homo sapiens
  Payload ID: 10610
  Gene Symbol: MCTP1
  Gene Name: multiple C2 domains, transmembrane 1
  ENSP ID: ENSP00000426294
TLKDPHYPDHDLGIILLSVILTPKEGESRDVELSENEVVGSYFSVKSLFWRFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVV

SEQ ID NO: 53379 - protein, 515 aa, Homo sapiens
  Payload ID: 10610
  Gene Symbol: MCTP1
  Gene Name: multiple C2 domains, transmembrane 1
  Uniprot ID: Q6DN14
  ENSP ID: ENSP00000426417
MDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 53380 - protein, 600 aa, Homo sapiens
  Payload ID: 10610
  Gene Symbol: MCTP1
  Gene Name: multiple C2 domains, transmembrane 1
  Uniprot ID: Q6DN14
  ENSP ID: ENSP00000426438
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVALYGTFINV

SEQ ID NO: 53381 - protein, 489 aa, Homo sapiens
  Payload ID: 10610
  Gene Symbol: MCTP1
  Gene Name: multiple C2 domains, transmembrane 1
  ENSP ID: ENSP00000431075
MGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPL

SEQ ID NO: 53382 - protein, 878 aa, Homo sapiens
  Payload ID: 10611
  Gene Symbol: MCTP2
  Gene Name: multiple C2 domains, transmembrane 2
  Uniprot ID: Q6DN12
  ENSP ID: ENSP00000350377
MDLDKPSVWGSLKQRTRPLLINLSKKKVKKNPSKPPDLRARHHLDRRLSLSVPDLLEAEALAPEGRPYSGPQSSYTSVPSSLSTAGIFPKSSSSSLKQSEEELDWSQEEASHLHVVETDSEEAYASPAERRRVSSNGIFDLQKTSLGGDAPEEPEKLCGSSDLNASMTSQHFEEQSVPGEASDGLSNLPSPFAYLLTIHLKEGRNLVVRDRCGTSDPYVKFKLNGKTLYKSKVIYKNLNPVWDEIVVLPIQSLDQKLRVKVYDRDLTTSDFMGSAFVILSDLELNRTTEHILKLEDPNSLEDDMGVIVLNLNLVVKQGDFKRHRWSNRKRLSASKSSLIRNLRLSESLKKNQLWNGIISITLLEGKNVSGGSMTEMFVQLKLGDQRYKSKTLCKSANPQWQEQFDFHYFSDRMGILDIEVWGKDNKKHEERLGTCKVDISALPLKQANCLELPLDSCLGALLMLVTLTPCAGVSVSDLCVCPLADLSERKQITQRYCLQNSLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRITMAIWNTMQFLKSCFQWESTLRSTIAFAVFLITVWNFELYMIPLALLLIFVYNFIRPVKGKVSSIQDSQESTDIDDEEDEDDKESEKKGLIERIYMVQDIVSTVQNVLEEIASFGERIKNTFNWTVPFLSSLACLILAAATIILYFIPLRYIILIWGINKFTKKLRNPYSIDNNELLDFLSRVPSDVQKVQYAELKLCSSHSPLRKKRSAL

SEQ ID NO: 53383 - protein, 199 aa, Homo sapiens
  Payload ID: 10611
  Gene Symbol: MCTP2
  Gene Name: multiple C2 domains, transmembrane 2
  Uniprot ID: Q6DN12
  ENSP ID: ENSP00000388887
MDLDKPSVWGSLKQRTRPLLINLSKKKVKKNPSKPPDLRARHHLDRRLSLSVPDLLEAEALAPEGRPYSGPQSSYTSVPSSLSTAGIFPKSSSSSLKQSEEELDWSQEEASHLHVVETDSEEAYASPAERRRVSSNGIFDLQKTSLGGDAPEEPEKLCGSSDLNASMTSQHFEEQSDSQKFEMTQKFNWAHVIHIQKQT

SEQ ID NO: 53384 - protein, 823 aa, Homo sapiens
  Payload ID: 10611
  Gene Symbol: MCTP2
  Gene Name: multiple C2 domains, transmembrane 2
  Uniprot ID: Q6DN12
  ENSP ID: ENSP00000395109
MDLDKPSVWGSLKQRTRPLLINLSKKKVKKNPSKPPDLRARHHLDRRLSLSVPDLLEAEALAPEGRPYSGPQSSYTSVPSSLSTAGIFPKSSSSSLKQSEEELDWSQEEASHLHVVETDSEEAYASPAERRRVSSNGIFDLQKTSLGGDAPEEPEKLCGSSDLNASMTSQHFEEQSVPGEASDGLSNLPSPFAYLLTIHLKEGRNLVVRDRCGTSDPYVKFKLNGKTLYKSKVIYKNLNPVWDEIVVLPIQSLDQKLRVKVYDRDLTTSDFMGSAFVILSDLELNRTTEHILKLEDPNSLEDDMGVIVLNLNLVVKQGDFKRHRWSNRKRLSASKSSLIRNLRLSESLKKNQLWNGIISITLLEGKNVSGGSMTEMFVQLKLGDQRYKSKTLCKSANPQWQEQFDFHYFSDRMGILDIEVWGKDNKKHEERLGTCKVDISALPLKQANCLELPLDSCLGALLMLVTLTPCAGVSVSDLCVCPLADLSERKQITQRYCLQNSLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRITMAIWNTMQFLKSCFQWESTLRSTIAFAESEKKGLIERIYMVQDIVSTVQNVLEEIASFGERIKNTFNWTVPFLSSLACLILAAATIILYFIPLRYIILIWGINKFTKKLRNPYSIDNNELLDFLSRVPSDVQKVQYAELKLCSSHSPLRKKRSAL

SEQ ID NO: 53385 - protein, 396 aa, Homo sapiens
  Payload ID: 10611
  Gene Symbol: MCTP2
  Gene Name: multiple C2 domains, transmembrane 2
  ENSP ID: ENSP00000438521
MDLDKPSVWGSLKQRTRPLLINLSKKKVKKNPSKPPDLRARHHLDRRLSLSVPDLLEAEALAPEGRPYSGPQSSYTSVPSSLSTAGIFPKSSSSSLKQSEEELDWSQEEASHLHVVETDSEEAYASPAERRRVSSNGIFDLQKTSLGGDAPEEPEKLCGSSDLNASMTSQHFEEQSVPGEASDGLSNLPSPFAYLLTIHLKEGRNLVVRDRCGTSDPYVKFKLNGKTLYKSKVIYKNLNPVWDEIVVLPIQSLDQKLRVKVYDRDLTTSDFMGSAFVILSDLELNRTTEHILKLEDPNSLEDDMGVIVLNLNLVVKQGDFKRHRWSNRKRLSASKSSLIRNLRLSESLKKNQLWNGIISITLLEGKNVSGGSMTEMFVQLKLGDQRYKSKDGHFGH

SEQ ID NO: 53386 - protein, 306 aa, Homo sapiens
  Payload ID: 10611
  Gene Symbol: MCTP2
  Gene Name: multiple C2 domains, transmembrane 2
  Uniprot ID: Q6DN12
  ENSP ID: ENSP00000454847
MGILDIEVWGKDNKKHEERLGTCKVDISALPLKQANCLELPLDSCLGALLMLVTLTPCAGVSVSDLCVCPLADLSERKQITQRYCLQNSLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRITMAIWNTMQFLKSCFQWESTLRSTIAFAHRKEEPPLSMKCTLFSGDIGPSL

SEQ ID NO: 53387 - protein, 146 aa, Homo sapiens
  Payload ID: 10612
  Gene Symbol: MCFD2
  Gene Name: multiple coagulation factor deficiency 2
  Uniprot ID: Q8NI22
  ENSP ID: ENSP00000317271
MTMRSLLRTPFLCGLLWAFCAPGARAEEPAASFSQPGSMGLDKNTVHDQEHIMEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 53388 - protein, 146 aa, Homo sapiens; identical to SEQ ID NO: 53387
  Payload ID: 10612
  Gene Symbol: MCFD2
  Gene Name: multiple coagulation factor deficiency 2
  Uniprot ID: Q8NI22
  ENSP ID: ENSP00000386261

SEQ ID NO: 53389 - protein, 146 aa, Homo sapiens; identical to SEQ ID NO: 53387
  Payload ID: 10612
  Gene Symbol: MCFD2
  Gene Name: multiple coagulation factor deficiency 2
  Uniprot ID: Q8NI22
  ENSP ID: ENSP00000386279

SEQ ID NO: 53390 - protein, 146 aa, Homo sapiens; identical to SEQ ID NO: 53387
  Payload ID: 10612
  Gene Symbol: MCFD2
  Gene Name: multiple coagulation factor deficiency 2
  Uniprot ID: Q8NI22
  ENSP ID: ENSP00000386386

SEQ ID NO: 53391 - protein, 146 aa, Homo sapiens; identical to SEQ ID NO: 53387
  Payload ID: 10612
  Gene Symbol: MCFD2
  Gene Name: multiple coagulation factor deficiency 2
  Uniprot ID: Q8NI22
  ENSP ID: ENSP00000386651

SEQ ID NO: 53392 - protein, 94 aa, Homo sapiens
  Payload ID: 10612
  Gene Symbol: MCFD2
  Gene Name: multiple coagulation factor deficiency 2
  Uniprot ID: Q8NI22
  ENSP ID: ENSP00000386941
MEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 53393 - protein, 94 aa, Homo sapiens; identical to SEQ ID NO: 53392
  Payload ID: 10612
  Gene Symbol: MCFD2
  Gene Name: multiple coagulation factor deficiency 2
  Uniprot ID: Q8NI22
  ENSP ID: ENSP00000387082

SEQ ID NO: 53394 - protein, 94 aa, Homo sapiens; identical to SEQ ID NO: 53392
  Payload ID: 10612
  Gene Symbol: MCFD2
  Gene Name: multiple coagulation factor deficiency 2
  Uniprot ID: Q8NI22
  ENSP ID: ENSP00000387202

SEQ ID NO: 53395 - protein, 90 aa, Homo sapiens
  Payload ID: 10612
  Gene Symbol: MCFD2
  Gene Name: multiple coagulation factor deficiency 2
  ENSP ID: ENSP00000387360
SQPGSMGLDKNTVHDQEHIMEHLEGVINKPEAEMSPQELQLHYFKMHDYDGNNLLDGLELSTAITHVHKEANLCTELTLRRTGTFPIKEE

SEQ ID NO: 53396 - protein, 61 aa, Homo sapiens
  Payload ID: 10612
  Gene Symbol: MCFD2
  Gene Name: multiple coagulation factor deficiency 2
  ENSP ID: ENSP00000387541
MTMRSLLRTPFLCGLLWAFCAPGARAEEPAASFSQPGSMGLDKNTVHDQEHIMEHLEGVIN

SEQ ID NO: 53397 - protein, 127 aa, Homo sapiens
  Payload ID: 10612
  Gene Symbol: MCFD2
  Gene Name: multiple coagulation factor deficiency 2
  Uniprot ID: Q8NI22
  ENSP ID: ENSP00000394647
MLSVCSCRTSSGMRSQWPSARQRSSSLSTFRHIMEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 53398 - protein, 146 aa, Homo sapiens; identical to SEQ ID NO: 53387
  Payload ID: 10612
  Gene Symbol: MCFD2
  Gene Name: multiple coagulation factor deficiency 2
  Uniprot ID: Q8NI22
  ENSP ID: ENSP00000402717

SEQ ID NO: 53399 - protein, 1140 aa, Homo sapiens
  Payload ID: 10613
  Gene Symbol: MEGF10
  Gene Name: multiple EGF-like-domains 10
  Uniprot ID: Q96KG7
  ENSP ID: ENSP00000274473
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIGAIAGIIILVLVVLFLLALFIIYRHKQKGKESSMPAVTYTPAMRVVNADYTISGTLPHSNGGNANSHYFTNPSYHTLTQCATSPHVNNRDRMTVTKSKNNQLFVNLKNVNPGKRGPVGDCTGTLPADWKHGGYLNELGAFGLDRSYMGKSLKDLGKNSEYNSSNCSLSSSENPYATIKDPPVLIPKSSECGYVEMKSPARRDSPYAEINNSTSANRNVYEVEPTVSVVQGVFSNNGRLSQDPYDLPKNSHIPCHYDLLPVRDSSSSPKQEDSGGSSSNSSSSSE

SEQ ID NO: 53400 - protein, 567 aa, Homo sapiens
  Payload ID: 10613
  Gene Symbol: MEGF10
  Gene Name: multiple EGF-like-domains 10
  Uniprot ID: Q96KG7
  ENSP ID: ENSP00000416284
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGLF

SEQ ID NO: 53401 - protein, 567 aa, Homo sapiens; identical to SEQ ID NO: 53400
  Payload ID: 10613
  Gene Symbol: MEGF10
  Gene Name: multiple EGF-like-domains 10
  Uniprot ID: Q96KG7
  ENSP ID: ENSP00000423195

SEQ ID NO: 53402 - protein, 1140 aa, Homo sapiens; identical to SEQ ID NO: 53399
  Payload ID: 10613
  Gene Symbol: MEGF10
  Gene Name: multiple EGF-like-domains 10
  Uniprot ID: Q96KG7
  ENSP ID: ENSP00000423354

SEQ ID NO: 53403 - protein, 969 aa, Homo sapiens
  Payload ID: 10614
  Gene Symbol: MEGF11
  Gene Name: multiple EGF-like-domains 11
  Uniprot ID: A6BM72
  ENSP ID: ENSP00000288745
MHTPSIRSITHDAQTSSTGSSAPGTALCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 53404 - protein, 1140 aa, Homo sapiens
  Payload ID: 10614
  Gene Symbol: MEGF11
  Gene Name: multiple EGF-like-domains 11
  ENSP ID: ENSP00000378976
MVLSLTGLIAFSFLQATLALNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSDLSQSSSHAHCFSNSSYHALACGGPATSQASTLDRNSPTKLSNKSLDRDTAGWTPYSYVNVLDSHFQISALEARYPPEDFYIELRHLSRPAEPHSPGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 53405 - protein, 1044 aa, Homo sapiens
  Payload ID: 10614
  Gene Symbol: MEGF11
  Gene Name: multiple EGF-like-domains 11
  Uniprot ID: A6BM72
  ENSP ID: ENSP00000386908
MVLSLTGLIAFSFLQATLALNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 53406 - protein, 227 aa, Homo sapiens
  Payload ID: 10614
  Gene Symbol: MEGF11
  Gene Name: multiple EGF-like-domains 11
  ENSP ID: ENSP00000401400
MGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPC

SEQ ID NO: 53407 - protein, 1044 aa, Homo sapiens; identical to SEQ ID NO: 53405
  Payload ID: 10614
  Gene Symbol: MEGF11
  Gene Name: multiple EGF-like-domains 11
  Uniprot ID: A6BM72
  ENSP ID: ENSP00000414475

SEQ ID NO: 53408 - protein, 579 aa, Homo sapiens
  Payload ID: 10614
  Gene Symbol: MEGF11
  Gene Name: multiple EGF-like-domains 11
  ENSP ID: ENSP00000456118
MGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRKPHLLASQPLRIPCCGLLATVGIVQTSREGGMQAAPGLVVPDSCPTRTEELCRGSSRPDWIQGIDKPKVLEGQGCKAAQQHFLGRTVGAYASVRMAPAVTTSVASAPAAQASPGNTVSRDVPQEPLAMGVSSYVSA

SEQ ID NO: 53409 - protein, 30 aa, Homo sapiens
  Payload ID: 10614
  Gene Symbol: MEGF11
  Gene Name: multiple EGF-like-domains 11
  ENSP ID: ENSP00000477691
  MOD_RES (1)..(1): Any amino acid
XCLPGFSGALCNQASKWQKQILIPTCMLKG

SEQ ID NO: 53410 - protein, 828 aa, Homo sapiens
  Payload ID: 10614
  Gene Symbol: MEGF11
  Gene Name: multiple EGF-like-domains 11
  ENSP ID: ENSP00000478094
MHTPSIRSITHDAQTSSTGSSAPGTALCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLS

SEQ ID NO: 53411 - protein, 117 aa, Homo sapiens
  Payload ID: 10614
  Gene Symbol: MEGF11
  Gene Name: multiple EGF-like-domains 11
  ENSP ID: ENSP00000478311
  MOD_RES (1)..(1): Any amino acid
XLSQSSSHAHCFSNSSYHALACGGPATSQASTLDRNSPTKLSNKSLDRDTAGWTPYSYVNVLDSHFQISALEARYPPEDFYIELRHLSRPAEPHSPDKPWIQERTDRTRAERCLWNG

SEQ ID NO: 53412 - protein, 621 aa, Homo sapiens
  Payload ID: 10614
  Gene Symbol: MEGF11
  Gene Name: multiple EGF-like-domains 11
  ENSP ID: ENSP00000480105
GAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRKPHLLASQPLRIPCCGLLATVGIVQTSREGGMQAAPGLVVPDSCPTRTEELCRGSSRPDWIQGIDKPKVLEGQGCKAAQQHFLGRTVGAYASVRMAPAVTTSVASAPAAQASPGNTVSRDVPQEPLAMGVSSYVSA

SEQ ID NO: 53413 - protein, 903 aa, Homo sapiens
  Payload ID: 10614
  Gene Symbol: MEGF11
  Gene Name: multiple EGF-like-domains 11
  ENSP ID: ENSP00000480614
MVLSLTGLIAFSFLQATLALNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLS

SEQ ID NO: 53414 - protein, 26 aa, Homo sapiens
  Payload ID: 10614
  Gene Symbol: MEGF11
  Gene Name: multiple EGF-like-domains 11
  ENSP ID: ENSP00000483007
  MOD_RES (1)..(1): Any amino acid
XWTPYSYVNVLDQCPGGQVPARGLLH

SEQ ID NO: 53415 - protein, 30 aa, Homo sapiens; identical to SEQ ID NO: 53409
  Payload ID: 10614
  Gene Symbol: MEGF11
  Gene Name: multiple EGF-like-domains 11
  ENSP ID: ENSP00000488336
  MOD_RES (1)..(1): Any amino acid

SEQ ID NO: 53416 - protein, 1229 aa, Homo sapiens
  Payload ID: 10615
  Gene Symbol: MEGF6
  Gene Name: multiple EGF-like-domains 6
  Uniprot ID: O75095
  ENSP ID: ENSP00000294599
MGASRDRGLAALWCLGLLGGLARVAGTHYRYLWRGCYPCHLGQAGYPVSAGDQRPDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIDVDDCADSPCCQQVCTNNPGGYECGCYAGYRLSADGCGCEDVDECASSRGGCEHHCTNLAGSFQCSCEAGYRLHEDRRGCSPLEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNETCPPDTFGKNCSFSCSCQNGGTCDSVTGACRCPPGVSGTNCEDGCPKGYYGKHCRKKCNCANRGRCHRLYGACLCDPGLYGRFCHLTCPPWAFGPGCSEECQCVQPHTQSCDKRDGSCSCKAGFRGERCQAECELGYFGPGCWQACTCPVGVACDSVSGECGKRCPAGFQGEDCGQECPVGTFGVNCSSSCSCGGAPCHGVTGQCRCPPGRTGEDCEADCPEGRWGLGCQEICPACQHAARCDPETGACLCLPGFVGSRCQDVCPAGWYGPSCQTRCSCANDGHCHPATGHCSCAPGWTGFSCQRACDTGHWGPDCSHPCNCSAGHGSCDAISGLCLCEAGYVGPRCEQQCPQGHFGPGCEQRCQCQHGAACDHVSGACTCPAGWRGTFCEHACPAGFFGLDCRSACNCTAGAACDAVNGSCLCPAGRRGPRCAEKCLPRDVRAGCRHSGGCLNGGLCDPHTGRCLCPAGWTGDKCQSPCLRGWFGEACAQRCSCPPGAACHHVTGACRCPPGFTGSGCEQGCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQACEHRRSGATCNLDCRRGQFGPSCTLHCDCGGGADCDPVSGQCHCVDGYMGPTCREGGPLRLPENPSLAQGSAGTLPASSRPTSRSGGPARH

SEQ ID NO: 53417 - protein, 1541 aa, Homo sapiens
  Payload ID: 10615
  Gene Symbol: MEGF6
  Gene Name: multiple EGF-like-domains 6
  Uniprot ID: O75095
  ENSP ID: ENSP00000348982
MSFLEEARAAGRAVVLALVLLLLPAVPVGASVPPRPLLPLQPGMPHVCAEQELTLVGRRQPCVQALSHTVPVWKAGCGWQAWCVGHERRTVYYMGYRQVYTTEARTVLRCCRGWMQQPDEEGCLSAECSASLCFHGGRCVPGSAQPCHCPPGFQGPRCQYDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIDVDDCADSPCCQQVCTNNPGGYECGCYAGYRLSADGCGCEDVDECASSRGGCEHHCTNLAGSFQCSCEAGYRLHEDRRGCSPLEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNETCPPDTFGKNCSFSCSCQNGGTCDSVTGACRCPPGVSGTNCEDGCPKGYYGKHCRKKCNCANRGRCHRLYGACLCDPGLYGRFCHLTCPPWAFGPGCSEECQCVQPHTQSCDKRDGSCSCKAGFRGERCQAECELGYFGPGCWQACTCPVGVACDSVSGECGKRCPAGFQGEDCGQECPVGTFGVNCSSSCSCGGAPCHGVTGQCRCPPGRTGEDCEADCPEGRWGLGCQEICPACQHAARCDPETGACLCLPGFVGSRCQDVCPAGWYGPSCQTRCSCANDGHCHPATGHCSCAPGWTGFSCQRACDTGHWGPDCSHPCNCSAGHGSCDAISGLCLCEAGYVGPRCEQQCPQGHFGPGCEQRCQCQHGAACDHVSGACTCPAGWRGTFCEHACPAGFFGLDCRSACNCTAGAACDAVNGSCLCPAGRRGPRCAETCPAHTYGHNCSQACACFNGASCDPVHGQCHCAPGWMGPSCLQACPAGLYGDNCRHSCLCQNGGTCDPVSGHCACPEGWAGLACEKECLPRDVRAGCRHSGGCLNGGLCDPHTGRCLCPAGWTGDKCQSPCLRGWFGEACAQRCSCPPGAACHHVTGACRCPPGFTGSGCEQACPPGSFGEDCAQMCQCPGENPACHPATGTCSCAAGYHGPSCQQRCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQACEHPCPPGFHGAGCQGLCWCQHGAPCDPISGRCLCPAGFHGHFCERGCEPGSFGEGCHQRCDCDGGAPCDPVTGLCLCPPGRSGATCNLDCRRGQFGPSCTLHCDCGGGADCDPVSGQCHCVDGYMGPTCREGGPLRLPENPSLAQGSAGTLPASSRPTSRSGGPARH

SEQ ID NO: 53418 - protein, 1323 aa, Homo sapiens
  Payload ID: 10615
  Gene Symbol: MEGF6
  Gene Name: multiple EGF-like-domains 6
  ENSP ID: ENSP00000419033
MSFLEEARAAGRAVVLALVLLLLPAVPVGASVPPRPLLPLQPGMPHVCAEQELTLVGRRQPCVQALSHTVPVWKAGCGWQAWCVGHERRTVYYMGYRQVYTTEARTVLRCCRGWMQQPDEEGCLSDVGECANANGGCAGRCRDTVGGFYCRWPPPSHQLQGDGETCQDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIDVDDCADSPCCQQVCTNNPGGYECGCYAGYRLSADGCGCEDVDECASSRGGCEHHCTNLAGSFQCSCEAGYRLHEDRRGCSPLEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNETCPPDTFGKNCSFSCSCQNGGTCDSVTGACRCPPGVSGTNCEDGCPKGYYGKHCRKKCNCANRGRCHRLYGACLCDPGLYGRFCHLTCPPWAFGPGCSEECQCVQPHTQSCDKRDGSCSCKAGFRGERCQAECELGYFGPGCWQACTCPVGVACDSVSGECGKRCPAGFQGEDCGQECPVGTFGVNCSSSCSCGGAPCHGVTGQCRCPPGRTGEDCEADCPEGRWGLGCQEICPACQHAARCDPETGACLCLPGFVGSRCQDVCPAGWYGPSCQTRCSCANDGHCHPATGHCSCAPGWTGFSCQRACDTGHWGPDCSHPCNCSAGHGSCDAISGLCLCEAGYVGPRCEQQCPQGHFGPGCEQRCQCQHGAACDHVSGACTCPAGWRGTFCEHACPAGFFGLDCRSACNCTAGAACDAVNGSCLCPAGRRGPRCAETCPAHTYGHNCSQACACFNGASCDPVHGQCHCAPGWMGPSCLQACPAGLYGDNCRHSCLCQNGGTCDPVSGHCACPEGWAGLACEKECLPRDVRAGCRHSGGCLNGGLCDPHTGRCLCPAGWTGDKCQSPCAKGTFGPHCEGRCACRWGGPCHLATGACLCPPGWRGAPGVRMPACGAGLERPVPSAAAARLALPATTSLGPAAVPLASLAPAASRPAHPAALGRTVRRCASVPVRTRPATLPPGPAHVLLATTAPAASNDVRPGGMGQAVNSCVGVSTGAPVMRPRGPAAAPLGSSGRTATSPVRRAASAPTAPTCVGVGRGRPATL

SEQ ID NO: 53419 - protein, 248 aa, Homo sapiens
  Payload ID: 10615
  Gene Symbol: MEGF6
  Gene Name: multiple EGF-like-domains 6
  ENSP ID: ENSP00000420386
  MOD_RES (1)..(1): Any amino acid
XDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQACEHPCPPGFHGAGCQGLCWCQHGAPCDPISGRCLCPAGFHGHFCERDCRRGQFGPSCTLHCDCGGGADCDPVSGQCHCVDGYMGPTCREGGPLRLPENPSL

SEQ ID NO: 53420 - protein, 2845 aa, Homo sapiens
  Payload ID: 10616
  Gene Symbol: MEGF8
  Gene Name: multiple EGF-like-domains 8
  Uniprot ID: Q7Z7M0
  ENSP ID: ENSP00000251268
MALGKVLAMALVLALAVLGSLSPGARAGDCKGQRQVLREAPGFVTDGAGNYSVNGNCEWLIEAPSPQHRILLDFLFLDTECTYDYLFVYDGDSPRGPLLASLSGSTRPPPIEASSGKMLLHLFSDANYNLLGFNASFRFSLCPGGCQSHGQCQPPGVCACEPGWGGPDCGLQECSAYCGSHGTCASPLGPCRCEPGFLGRACDLHLWENQGAGWWHNVSARDPAFSARIGAAGAFLSPPGLLAVFGGQDLNNALGDLVLYNFSANTWESWDLSPAPAARHSHVAVAWAGSLVLMGGELADGSLTNDVWAFSPLGRGHWELLAPPASSSSGPPGLAGHAAALVDDVWLYVSGGRTPHDLFSSGLFRFRLDSTSGGYWEQVIPAGGRPPAATGHSMVFHAPSRALLVHGGHRPSTARFSVRVNSTELFHVDRHVWTTLKGRDGLQGPRERAFHTASVLGNYMVVYGGNVHTHYQEEKCYEDGIFFYHLGCHQWVSGAELAPPGTPEGRAAPPSGRYSHVAAVLGGSVLLVAGGYSGRPRGDLMAYKVPPFVFQAPAPDYHLDYCSMYTDHSVCSRDPECSWCQGACQAAPPPGTPLGACPAASCLGLGRLLGDCQACLAFSSPTAPPRGPGTLGWCVHNESCLPRPEQARCRGEQISGTVGWWGPAPVFVTSLEACVTQSFLPGLHLLTFQQPPNTSQPDKVSIVRSTTITLTPSAETDVSLVYRGFIYPMLPGGPGGPGAEDVAVWTRAQRLHVLARMARGPDTENMEEVGRWVAHQEKETRRLQRPGSARLFPLPGRDHKYAVEIQGQLNGSAGPGHSELTLLWDRTGVPGGSEISFFFLEPYRSSSCTSYSSCLGCLADQGCGWCLTSATCHLRQGGAHCGDDGAGGSLLVLVPTLCPLCEEHRDCHACTQDPFCEWHQSTSRKGDAACSRRGRGRGALKSPEECPPLCSQRLTCEDCLANSSQCAWCQSTHTCFLFAAYLARYPHGGCRGWDDSVHSEPRCRSCDGFLTCHECLQSHECGWCGNEDNPTLGRCLQGDFSGPLGGGNCSLWVGEGLGLPVALPARWAYARCPDVDECRLGLARCHPRATCLNTPLSYECHCQRGYQGDGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKRDRMRNVRGSSRGLGQVPGEQPGSWGFREVRKKMALWAALAGTGGFLEEISPHLKEPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGEASTPRCKWCTNCPEGACIGRNGSCTSENDCRINQREVFWAGNCSEAACGAADCEQCTREGKCMWTRQFKRTGETRRILSVQPTYDWTCFSHSLLNVSPMPVESSPPLPCPTPCHLLPNCTSCLDSKGADGGWQHCVWSSSLQQCLSPSYLPLRCMAGGCGRLLRGPESCSLGCAQATQCALCLRRPHCGWCAWGGQDGGGRCMEGGLSGPRDGLTCGRPGASWAFLSCPPEDECANGHHDCNETQNCHDQPHGYECSCKTGYTMDNMTGLCRPVCAQGCVNGSCVEPDHCRCHFGFVGRNCSTECRCNRHSECAGVGARDHCLLCRNHTKGSHCEQCLPLFVGSAVGGGTCRPCHAFCRGNSHICISRKELQMSKGEPKKYSLDPEEIENWVTEGPSEDEAVCVNCQNNSYGEKCESCLQGYFLLDGKCTKCQCNGHADTCNEQDGTGCPCQNNTETGTCQGSSPSDRRDCYKYQCAKCRESFHGSPLGGQQCYRLISVEQECCLDPTSQTNCFHEPKRRALGPGRTVLFGVQPKFTNVDIRLTLDVTFGAVDLYVSTSYDTFVVRVAPDTGVHTVHIQPPPAPPPPPPPADGGPRGAGDPGGAGASSGPGAPAEPRVREVWPRGLITYVTVTEPSAVLVVRGVRDRLVITYPHEHHALKSSRFYLLLLGVGDPSGPGANGSADSQGLLFFRQDQAHIDLFVFFSVFFSCFFLFLSLCVLLWKAKQALDQRQEQRRHLQEMTKMASRPFAKVTVCFPPDPTAPASAWKPAGLPPPAFRRSEPFLAPLLLTGAGGPWGPMGGGCCPPAIPATTAGLRAGPITLEPTEDGMAGVATLLLQLPGGPHAPNGACLGSALVTLRHRLHEYCGGGGGAGGSGHGTGAGRKGLLSQDNLTSMSL

SEQ ID NO: 53421 - protein, 2778 aa, Homo sapiens
  Payload ID: 10616
  Gene Symbol: MEGF8
  Gene Name: multiple EGF-like-domains 8
  Uniprot ID: Q7Z7M0
  ENSP ID: ENSP00000334219
MALGKVLAMALVLALAVLGSLSPGARAGDCKGQRQVLREAPGFVTDGAGNYSVNGNCEWLIEAPSPQHRILLDFLFLDTECTYDYLFVYDGDSPRGPLLASLSGSTRPPPIEASSGKMLLHLFSDANYNLLGFNASFRFSLCPGGCQSHGQCQPPGVCACEPGWGGPDCGLQECSAYCGSHGTCASPLGPCRCEPGFLGRACDLHLWENQGAGWWHNVSARDPAFSARIGAAGAFLSPPGLLAVFGGQDLNNALGDLVLYNFSANTWESWDLSPAPAARHSHVAVAWAGSLVLMGGELADGSLTNDVWAFSPLGRGHWELLAPPASSSSGPPGLAGHAAALVDDVWLYVSGGRTPHDLFSSGLFRFRLDSTSGGYWEQVIPAGGRPPAATGHSMVFHAPSRALLVHGGHRPSTARFSVRVNSTELFHVDRHVWTTLKGRDGLQGPRERAFHTASVLGNYMVVYGGNVHTHYQEEKCYEDGIFFYHLGCHQWVSGAELAPPGTPEGRAAPPSGRYSHVAAVLGGSVLLVAGGYSGRPRGDLMAYKVPPFVFQAPAPDYHLDYCSMYTDHSVCSRDPECSWCQGACQAAPPPGTPLGACPAASCLGLGRLLGDCQACLAFSSPTAPPRGPGTLGWCVHNESCLPRPEQARCRGEQISGTVGWWGPAPVFVTSLEACVTQSFLPGLHLLTFQQPPNTSQPDKEEVGRWVAHQEKETRRLQRPGSARLFPLPGRDHKYAVEIQGQLNGSAGPGHSELTLLWDRTGVPGGSEISFFFLEPYRSSSCTSYSSCLGCLADQGCGWCLTSATCHLRQGGAHCGDDGAGGSLLVLVPTLCPLCEEHRDCHACTQDPFCEWHQSTSRKGDAACSRRGRGRGALKSPEECPPLCSQRLTCEDCLANSSQCAWCQSTHTCFLFAAYLARYPHGGCRGWDDSVHSEPRCRSCDGFLTCHECLQSHECGWCGNEDNPTLGRCLQGDFSGPLGGGNCSLWVGEGLGLPVALPARWAYARCPDVDECRLGLARCHPRATCLNTPLSYECHCQRGYQGDGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKRDRMRNVRGSSRGLGQVPGEQPGSWGFREVRKKMALWAALAGTGGFLEEISPHLKEPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGEASTPRCKWCTNCPEGACIGRNGSCTSENDCRINQREVFWAGNCSEAACGAADCEQCTREGKCMWTRQFKRTGETRRILSVQPTYDWTCFSHSLLNVSPMPVESSPPLPCPTPCHLLPNCTSCLDSKGADGGWQHCVWSSSLQQCLSPSYLPLRCMAGGCGRLLRGPESCSLGCAQATQCALCLRRPHCGWCAWGGQDGGGRCMEGGLSGPRDGLTCGRPGASWAFLSCPPEDECANGHHDCNETQNCHDQPHGYECSCKTGYTMDNMTGLCRPVCAQGCVNGSCVEPDHCRCHFGFVGRNCSTECRCNRHSECAGVGARDHCLLCRNHTKGSHCEQCLPLFVGSAVGGGTCRPCHAFCRGNSHICISRKELQMSKGEPKKYSLDPEEIENWVTEGPSEDEAVCVNCQNNSYGEKCESCLQGYFLLDGKCTKCQCNGHADTCNEQDGTGCPCQNNTETGTCQGSSPSDRRDCYKYQCAKCRESFHGSPLGGQQCYRLISVEQECCLDPTSQTNCFHEPKRRALGPGRTVLFGVQPKFTNVDIRLTLDVTFGAVDLYVSTSYDTFVVRVAPDTGVHTVHIQPPPAPPPPPPPADGGPRGAGDPGGAGASSGPGAPAEPRVREVWPRGLITYVTVTEPSAVLVVRGVRDRLVITYPHEHHALKSSRFYLLLLGVGDPSGPGANGSADSQGLLFFRQDQAHIDLFVFFSVFFSCFFLFLSLCVLLWKAKQALDQRQEQRRHLQEMTKMASRPFAKVTVCFPPDPTAPASAWKPAGLPPPAFRRSEPFLAPLLLTGAGGPWGPMGGGCCPPAIPATTAGLRAGPITLEPTEDGMAGVATLLLQLPGGPHAPNGACLGSALVTLRHRLHEYCGGGGGAGGSGHGTGAGRKGLLSQDNLTSMSL

SEQ ID NO: 53422 - protein, 439 aa, Homo sapiens
  Payload ID: 10616
  Gene Symbol: MEGF8
  Gene Name: multiple EGF-like-domains 8
  ENSP ID: ENSP00000367313
MRELPAGLLPPGREVHQCAKCRESFHGSPLGGQQCYRLISVEQECCLDPTSQTNCFHEPKRRALGPGRTVLFGVQPKFTNVDIRLTLDVTFGAVDLYVSTSYDTFVVRVAPDTGVHTVHIQPPPAPPPPPPPADGGPRGAGDPGGAGASSGPGAPAEPRVREVWPRGLITYVTVTEPSAVLVVRGVRDRLVITYPHEHHALKSSRFYLLLLGVGDPSGPGANGSADSQGLLFFRQDQAHIDLFVFFSVFFSCFFLFLSLCVLLWKAKQALDQRQEQRRHLQEMTKMASRPFAKVTVCFPPDPTAPASAWKPAGLPPPAFRRSEPFLAPLLLTGAGGPWGPMGGGCCPPAIPATTAGLRAGPITLEPTEDGMAGVATLLLQLPGGPHAPNGACLGSALVTLRHRLHEYCGGGGGAGGSGHGTGAGRKGLLSQDNLTSMSL

SEQ ID NO: 53423 - protein, 178 aa, Homo sapiens
  Payload ID: 10616
  Gene Symbol: MEGF8
  Gene Name: multiple EGF-like-domains 8
  ENSP ID: ENSP00000470620
NCSTECRCNRHSECAGVGARDHCLLCRNHTKGSHCEQCLPLFVGSAVGGGTCRPCHAFCRGNSHICISRKELQMSKGEPKKYSLDPEEIENWVTEGPSEDEAVCVNCQNNSYGEKCESCLQGYFLLDGKCTNAPSAGNHFTGVRWAASSATASSRWSRSAAWTPRPRPTASMSPNAGR

SEQ ID NO: 53424 - protein, 70 aa, Homo sapiens
  Payload ID: 10616
  Gene Symbol: MEGF8
  Gene Name: multiple EGF-like-domains 8
  ENSP ID: ENSP00000471370
  MOD_RES (1)..(1): Any amino acid
XHGACLSGDQAHRLGCGGSPCSPMPRSPEECRRLRTCSECLARHPRTLQPGDGEVVGTTSEEEGGDEINK

SEQ ID NO: 53425 - protein, 602 aa, Homo sapiens
  Payload ID: 10617
  Gene Symbol: MEGF9
  Gene Name: multiple EGF-like-domains 9
  Uniprot ID: Q9H1U4
  ENSP ID: ENSP00000363040
MNGGAERAMRSLPSLGGLALLCCAAAAAAAAVASAASAGNVTGGGGAAGQVDASPGPGLRGEPSHPFPRATAPTAQAPRTGPPRATVHRPLAATSPAQSPETTPLWATAGPSSTTFQAPLGPSPTTPPAAERTSTTSQAPTRPAPTTLSTTTGPAPTTPVATTVPAPTTPRTPTPDLPSSSNSSVLPTPPATEAPSSPPPEYVCNCSVVGSLNVNRCNQTTGQCECRPGYQGLHCETCKEGFYLNYTSGLCQPCDCSPHGALSIPCNSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFNIIILTVIIIVVVLLMGFVGAVYMYREYQNRKLNAPFWTIELKEDNISFSSYHDSIPNADVSGLLEDDGNEVAPNGQLTLTTPIHNYKA

SEQ ID NO: 53426 - protein, 610 aa, Homo sapiens
  Payload ID: 10618
  Gene Symbol: MEN1
  Gene Name: multiple endocrine neoplasia I
  Uniprot ID: O00255
  ENSP ID: ENSP00000308975
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPTASPPPEGPVLTFQSEKMKGMKELLVATKINSSAIKLQLTAQSQVQMKKQKVSTPSDYTLSFLKRQRKGL

SEQ ID NO: 53427 - protein, 610 aa, Homo sapiens; identical to SEQ ID NO: 53426
  Payload ID: 10618
  Gene Symbol: MEN1
  Gene Name: multiple endocrine neoplasia I
  Uniprot ID: O00255
  ENSP ID: ENSP00000323747

SEQ ID NO: 53428 - protein, 615 aa, Homo sapiens
  Payload ID: 10618
  Gene Symbol: MEN1
  Gene Name: multiple endocrine neoplasia I
  Uniprot ID: O00255
  ENSP ID: ENSP00000337088
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGWSPVGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPTASPPPEGPVLTFQSEKMKGMKELLVATKINSSAIKLQLTAQSQVQMKKQKVSTPSDYTLSFLKRQRKGL

SEQ ID NO: 53429 - protein, 615 aa, Homo sapiens; identical to SEQ ID NO: 53428
  Payload ID: 10618
  Gene Symbol: MEN1
  Gene Name: multiple endocrine neoplasia I
  Uniprot ID: O00255
  ENSP ID: ENSP00000366530

SEQ ID NO: 53430 - protein, 555 aa, Homo sapiens
  Payload ID: 10618
  Gene Symbol: MEN1
  Gene Name: multiple endocrine neoplasia I
  ENSP ID: ENSP00000366533
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQVRQKVRIVSREAEAAEAEEPWGEEAREGRRRGPRRESKPEEPPPPKKPALDKGLGTGQGAVSGPPRKPPGTVAGTARGPEGGSTAQVPAPTASPPPEGPVLTFQSEKMKGMKELLVATKINSSAIKLQLTAQSQVQMKKQKVSTPSDYTLSFLKRQRKGL

SEQ ID NO: 53431 - protein, 575 aa, Homo sapiens
  Payload ID: 10618
  Gene Symbol: MEN1
  Gene Name: multiple endocrine neoplasia I
  Uniprot ID: O00255
  ENSP ID: ENSP00000366538
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPTASPPPEGPVLTFQSEKMKGMKELLVATKINSSAIKLQLTAQSQVQMKKQKVSTPSDYTLSFLKRQRKGL

SEQ ID NO: 53432 - protein, 610 aa, Homo sapiens; identical to SEQ ID NO: 53426
  Payload ID: 10618
  Gene Symbol: MEN1
  Gene Name: multiple endocrine neoplasia I
  Uniprot ID: O00255
  ENSP ID: ENSP00000366543

SEQ ID NO: 53433 - protein, 615 aa, Homo sapiens; identical to SEQ ID NO: 53428
  Payload ID: 10618
  Gene Symbol: MEN1
  Gene Name: multiple endocrine neoplasia I
  Uniprot ID: O00255
  ENSP ID: ENSP00000377899

SEQ ID NO: 53434 - protein, 615 aa, Homo sapiens; identical to SEQ ID NO: 53428
  Payload ID: 10618
  Gene Symbol: MEN1
  Gene Name: multiple endocrine neoplasia I
  Uniprot ID: O00255
  ENSP ID: ENSP00000377901

SEQ ID NO: 53435 - protein, 146 aa, Homo sapiens
  Payload ID: 10618
  Gene Symbol: MEN1
  Gene Name: multiple endocrine neoplasia I
  ENSP ID: ENSP00000388016
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSF

SEQ ID NO: 53436 - protein, 281 aa, Homo sapiens
  Payload ID: 10618
  Gene Symbol: MEN1
  Gene Name: multiple endocrine neoplasia I
  ENSP ID: ENSP00000394933
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALG

SEQ ID NO: 53437 - protein, 146 aa, Homo sapiens; identical to SEQ ID NO: 53435
  Payload ID: 10618
  Gene Symbol: MEN1
  Gene Name: multiple endocrine neoplasia I
  ENSP ID: ENSP00000402752

SEQ ID NO: 53438 - protein, 261 aa, Homo sapiens
  Payload ID: 10618
  Gene Symbol: MEN1
  Gene Name: multiple endocrine neoplasia I
  ENSP ID: ENSP00000411218
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQ

SEQ ID NO: 53439 - protein, 346 aa, Homo sapiens
  Payload ID: 10618
  Gene Symbol: MEN1
  Gene Name: multiple endocrine neoplasia I
  ENSP ID: ENSP00000413944
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTAT

SEQ ID NO: 53440 - protein, 312 aa, Homo sapiens
  Payload ID: 10619
  Gene Symbol: MINPP1
  Gene Name: multiple inositol-polyphosphate phosphatase 1
  Uniprot ID: Q9UNW1
  ENSP ID: ENSP00000361062
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNAGLSQFLLQSSSSLVMQRLFFHCFLSWATSKTRNP

SEQ ID NO: 53441 - protein, 487 aa, Homo sapiens
  Payload ID: 10619
  Gene Symbol: MINPP1
  Gene Name: multiple inositol-polyphosphate phosphatase 1
  Uniprot ID: Q9UNW1
  ENSP ID: ENSP00000361064
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 53442 - protein, 286 aa, Homo sapiens
  Payload ID: 10619
  Gene Symbol: MINPP1
  Gene Name: multiple inositol-polyphosphate phosphatase 1
  Uniprot ID: Q9UNW1
  ENSP ID: ENSP00000437823
MCLFQLCGLVRYMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 53443 - protein, 2070 aa, Homo sapiens
  Payload ID: 10620
  Gene Symbol: MPDZ
  Gene Name: multiple PDZ domain protein
  Uniprot ID: O75970
  ENSP ID: ENSP00000320006
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 53444 - protein, 2037 aa, Homo sapiens
  Payload ID: 10620
  Gene Symbol: MPDZ
  Gene Name: multiple PDZ domain protein
  Uniprot ID: O75970
  ENSP ID: ENSP00000370410
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 53445 - protein, 191 aa, Homo sapiens
  Payload ID: 10620
  Gene Symbol: MPDZ
  Gene Name: multiple PDZ domain protein
  ENSP ID: ENSP00000389705
MALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEAPSQSESEPEKAPLCSVPPPPPSAFAEMGSDHTQSSASKISQDVDKEDEFGYSWKNIRERYGTLTGELHMIELEKGHSGLGLSLAGNKD

SEQ ID NO: 53446 - protein, 79 aa, Homo sapiens
  Payload ID: 10620
  Gene Symbol: MPDZ
  Gene Name: multiple PDZ domain protein
  ENSP ID: ENSP00000406902
  MOD_RES (1)..(1): Any amino acid
XFASDPATCPIIPGCETTIEISKGRTGLGLSIVGGSDTLLGAIIIHEVYEEGAACKDGRLWAGDQILESVSHFCTGEWN

SEQ ID NO: 53447 - protein, 2037 aa, Homo sapiens; identical to SEQ ID NO: 53444
  Payload ID: 10620
  Gene Symbol: MPDZ
  Gene Name: multiple PDZ domain protein
  Uniprot ID: O75970
  ENSP ID: ENSP00000415208

SEQ ID NO: 53448 - protein, 611 aa, Homo sapiens
  Payload ID: 10620
  Gene Symbol: MPDZ
  Gene Name: multiple PDZ domain protein
  ENSP ID: ENSP00000415964
NKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 53449 - protein, 34 aa, Homo sapiens
  Payload ID: 10620
  Gene Symbol: MPDZ
  Gene Name: multiple PDZ domain protein
  ENSP ID: ENSP00000437651
  MOD_RES (1)..(1): Any amino acid
XSASKISQDVDKEDEFGYSWSKLCFCDAFNCKRY

SEQ ID NO: 53450 - protein, 2041 aa, Homo sapiens
  Payload ID: 10620
  Gene Symbol: MPDZ
  Gene Name: multiple PDZ domain protein
  Uniprot ID: O75970
  ENSP ID: ENSP00000439807
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 53451 - protein, 30 aa, Homo sapiens
  Payload ID: 10620
  Gene Symbol: MPDZ
  Gene Name: multiple PDZ domain protein
  ENSP ID: ENSP00000441111
  MOD_RES (1)..(1): Any amino acid
XQVAQVLRQCGNRVKLMLLLRKVKKVRHLM

SEQ ID NO: 53452 - protein, 128 aa, Homo sapiens
  Payload ID: 10620
  Gene Symbol: MPDZ
  Gene Name: multiple PDZ domain protein
  ENSP ID: ENSP00000443672
MALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEKSPLPSLLHNLYPKYNFSSTNPFADS

SEQ ID NO: 53453 - protein, 2008 aa, Homo sapiens
  Payload ID: 10620
  Gene Symbol: MPDZ
  Gene Name: multiple PDZ domain protein
  Uniprot ID: O75970
  ENSP ID: ENSP00000444151
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 53454 - protein, 1006 aa, Homo sapiens
  Payload ID: 10620
  Gene Symbol: MPDZ
  Gene Name: multiple PDZ domain protein
  ENSP ID: ENSP00000444230
VMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 53455 - protein, 929 aa, Homo sapiens
  Payload ID: 10620
  Gene Symbol: MPDZ
  Gene Name: multiple PDZ domain protein
  ENSP ID: ENSP00000444717
MALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 53456 - protein, 95 aa, Homo sapiens
  Payload ID: 10620
  Gene Symbol: MPDZ
  Gene Name: multiple PDZ domain protein
  ENSP ID: ENSP00000446298
  MOD_RES (1)..(1): Any amino acid
XMGSDHTQSSASKISQDVDKEDEFGYSWKNIRERYGTLTGELHMIELEKGHSGLGLSLAGNKDRSRMSVFIVGIDPNGAAGKDGRLQIADELLEK

SEQ ID NO: 53457 - protein, 2084 aa, Homo sapiens
  Payload ID: 10620
  Gene Symbol: MPDZ
  Gene Name: multiple PDZ domain protein
  ENSP ID: ENSP00000446358
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKFSAAPADDRAPFYVITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 53458 - protein, 273 aa, Homo sapiens
  Payload ID: 10621
  Gene Symbol: MVB12A
  Gene Name: multivesicular body subunit 12A
  Uniprot ID: Q96EY5
  ENSP ID: ENSP00000324810
MDPVPGTDSAPLAGLAWSSASAPPPRGFSAISCTVEGAPASFGKSFAQKSGYFLCLSSLGSLENPQENVVADIQIVVDKSPLPLGFSPVCDPMDSKASVSKKKRMCVKLLPLGATDTAVFDVRLSGKTKTVPGYLRIGDMGGFAIWCKKAKAPRPVPKPRGLSRDMQGLSLDAASQPSKGGLLERTASRLGSRASTLRRNDSIYEASSLYGISAMDGVPFTLHPRFEGKSCSPLAFSAFGDLTIKSLADIEEEYNYGFVVEKTAAARLPPSVS

SEQ ID NO: 53459 - protein, 273 aa, Homo sapiens
  Payload ID: 10621
  Gene Symbol: MVB12A
  Gene Name: multivesicular body subunit 12A
  ENSP ID: ENSP00000432526
MDPVPGTDSAPLAGLAWSSASAPPPRGFSAISCTVEGAPASFGKSFAQKSGYFLCLSSLGSLENPQENVVADIQIVVDKSPLPLGFSPVCDPMDSKASVSKKKRMCVKLLPLGATDTAVFDVRLSGKTKTVPGYLRIGDMGGFAIWCKKAKAPRPVPKPRGLSRDMQGLSLDAASQPSKGGLLERTASRLGSRASTLRRNDSIYEASSLYGISAMDGVPFTLHPRFEGKSCSPLAGLPSSRNTLKAARQTHIRCLESGGFGCSPRTSLALRLT

SEQ ID NO: 53460 - protein, 121 aa, Homo sapiens
  Payload ID: 10621
  Gene Symbol: MVB12A
  Gene Name: multivesicular body subunit 12A
  ENSP ID: ENSP00000433280
MDSKASVSKKKRMCVKLLPLGATDTAVFDVRLSGKTKTVPGYLRIGDMGGFAIWCKKAKAPRPVPKPRGLSRDMQGLSLDAASQPSKGGLLERTASRLGSRASTLRRNDSIYEASSLYGIS

SEQ ID NO: 53461 - protein, 199 aa, Homo sapiens
  Payload ID: 10621
  Gene Symbol: MVB12A
  Gene Name: multivesicular body subunit 12A
  ENSP ID: ENSP00000433677
MDPVPGTDSAPLAGLAWSSASAPPPRGFSAISCTVEGAPASFGKSFAQKSGYFLCLSSLGSLENPQENVVADIQIVVDKSPLPLGFSPVCDPMDSRTWAALPSGARRPRPRGQCPSPEVSAGTCRASLWMQPASQVRAASWSGQRQGWALGHPLCGGMTPSTRPPASMASQPWMGFPSHSTHDLRARAAAPWPSLLLGT

SEQ ID NO: 53462 - protein, 133 aa, Homo sapiens
  Payload ID: 10621
  Gene Symbol: MVB12A
  Gene Name: multivesicular body subunit 12A
  ENSP ID: ENSP00000435052
MGGFAIWCKKAKAPRPVPKPRGLSRDMQGLSLDAASQPSKGGLLERTASRLGSRASTLRRNDSIYEASSLYGISAMDGVPFTLHPRFEGKSCSPLAFSAFGDLTIKSLADIEEEYNYGFVVEKTAAARLPPSV

SEQ ID NO: 53463 - protein, 273 aa, Homo sapiens; identical to SEQ ID NO: 53458
  Payload ID: 10621
  Gene Symbol: MVB12A
  Gene Name: multivesicular body subunit 12A
  Uniprot ID: Q96EY5
  ENSP ID: ENSP00000444653

SEQ ID NO: 53464 - protein, 122 aa, Homo sapiens
  Payload ID: 10621
  Gene Symbol: MVB12A
  Gene Name: multivesicular body subunit 12A
  ENSP ID: ENSP00000470611
  MOD_RES (1)..(1): Any amino acid
XYLRIGDMGGFAIWCKKAKAPRPVPKPRGLSRDMQGLSLDAASQPSKGGLLERTASRLGSRASTLRRNDSIYEASSLYGISAMDGVPFTLHPRFEGKSCSPLYNYGFVVEKTAAARLPPSVS

SEQ ID NO: 53465 - protein, 121 aa, Homo sapiens; identical to SEQ ID NO: 53460
  Payload ID: 10621
  Gene Symbol: MVB12A
  Gene Name: multivesicular body subunit 12A
  ENSP ID: ENSP00000472288

SEQ ID NO: 53466 - protein, 319 aa, Homo sapiens
  Payload ID: 10622
  Gene Symbol: MVB12B
  Gene Name: multivesicular body subunit 12B
  Uniprot ID: Q9H7P6
  ENSP ID: ENSP00000354772
MRSCFCVRRSRDPPPPQPPPPPPQRGTDQSTMPEVKDLSEALPETSMDPITGVGVVASRNRAPTGYDVVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLPRHISLTLPATFRGRNSTRTDYEYQHSNLYAISAMDGVPFMISEKFSCVPESMQPFDLLGITIKSLAEIEKEYEYSFRTEQSAAARLPPSPTRCQQIPQS

SEQ ID NO: 53467 - protein, 205 aa, Homo sapiens
  Payload ID: 10622
  Gene Symbol: MVB12B
  Gene Name: multivesicular body subunit 12B
  ENSP ID: ENSP00000384751
MDTGLSSQPSEEDQSTMPEVKDLSEALPETSMDPITGVGVVASRNRAPTGYDVVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLP

SEQ ID NO: 53468 - protein, 221 aa, Homo sapiens
  Payload ID: 10622
  Gene Symbol: MVB12B
  Gene Name: multivesicular body subunit 12B
  Uniprot ID: Q9H7P6
  ENSP ID: ENSP00000485994
MRSCFCVRRSRDPPPPQPPPPPPQRGTDQSTMPEVKDLSEALPETSMDPITGVGVVASRNRAPTGYDVVAQTADGVDADLWKDGLFKSKVTRYLCFTRSFSKENSHLGNVLVDMKLIDIKDTLPVGFIPIQETVDTQEVAFRKKRLCIKFIPRDSTEAAICDIRIMGRTKQAPPQYTFIGELNSMGIWYRMGRVPRNHDSSQPTTPSQSSAASTPAPNLPR

SEQ ID NO: 53469 - protein, 597 aa, Homo sapiens
  Payload ID: 10623
  Gene Symbol: MRVI1
  Gene Name: murine retrovirus integration site 1 homolog
  Uniprot ID: Q9Y6F6
  ENSP ID: ENSP00000401205
MALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 53470 - protein, 912 aa, Homo sapiens
  Payload ID: 10623
  Gene Symbol: MRVI1
  Gene Name: murine retrovirus integration site 1 homolog
  Uniprot ID: Q9Y6F6
  ENSP ID: ENSP00000412130
MVKAPQSEERLARGGKENNSVLACGAQASWSIFGADAAEVPGTRGHSQQEAAMPHIPEDEEPPGEPQAAQSPAGQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 53471 - protein, 117 aa, Homo sapiens
  Payload ID: 10623
  Gene Symbol: MRVI1
  Gene Name: murine retrovirus integration site 1 homolog
  ENSP ID: ENSP00000431845
KNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPAEGG

SEQ ID NO: 53472 - protein, 821 aa, Homo sapiens
  Payload ID: 10623
  Gene Symbol: MRVI1
  Gene Name: murine retrovirus integration site 1 homolog
  ENSP ID: ENSP00000432067
LTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 53473 - protein, 68 aa, Homo sapiens
  Payload ID: 10623
  Gene Symbol: MRVI1
  Gene Name: murine retrovirus integration site 1 homolog
  ENSP ID: ENSP00000432312
MVKAPQSEERLARGGKENNSVLDRVSHCHPGWSAVVQPHLPGSSNSHASASQVAGITEIPSRRLLHWV

SEQ ID NO: 53474 - protein, 69 aa, Homo sapiens
  Payload ID: 10623
  Gene Symbol: MRVI1
  Gene Name: murine retrovirus integration site 1 homolog
  ENSP ID: ENSP00000432325
MPHIPEDEEPPGEPQAAQSPAGQGPPAAGVSCSPTPTIVLTGDATSPEGETDKNLANRVHSPHKRLSHR

SEQ ID NO: 53475 - protein, 904 aa, Homo sapiens
  Payload ID: 10623
  Gene Symbol: MRVI1
  Gene Name: murine retrovirus integration site 1 homolog
  Uniprot ID: Q9Y6F6
  ENSP ID: ENSP00000432436
MGMDLTCPFGISPACGAQASWSIFGADAAEVPGTRGHSQQEAAMPHIPEDEEPPGEPQAAQSPAGQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 53476 - protein, 597 aa, Homo sapiens; identical to SEQ ID NO: 53469
  Payload ID: 10623
  Gene Symbol: MRVI1
  Gene Name: murine retrovirus integration site 1 homolog
  Uniprot ID: Q9Y6F6
  ENSP ID: ENSP00000433296

SEQ ID NO: 53477 - protein, 63 aa, Homo sapiens
  Payload ID: 10623
  Gene Symbol: MRVI1
  Gene Name: murine retrovirus integration site 1 homolog
  ENSP ID: ENSP00000433970
  MOD_RES (1)..(1): Any amino acid
XSEERLARGGKENNSVLDRVSHCHPGWSAVVQPHLPGSSNSHASASQVAGITEIPSRRLLHWV

SEQ ID NO: 53478 - protein, 87 aa, Homo sapiens
  Payload ID: 10623
  Gene Symbol: MRVI1
  Gene Name: murine retrovirus integration site 1 homolog
  ENSP ID: ENSP00000434741
MVKAPQSEERLARGGKENNSVLGSSCRRSILQSNSHDCPDWGCHFTRRRNRQKPGQQSSQSPQEAFSPTLEGVHCLPDICGPRGAHH

SEQ ID NO: 53479 - protein, 428 aa, Homo sapiens
  Payload ID: 10623
  Gene Symbol: MRVI1
  Gene Name: murine retrovirus integration site 1 homolog
  ENSP ID: ENSP00000435658
MPHIPEDEEPPGEPQAAQSPAGQQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQKGDEADVSSPHPGEPEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEYASPEGQRCCGS

SEQ ID NO: 53480 - protein, 706 aa, Homo sapiens
  Payload ID: 10623
  Gene Symbol: MRVI1
  Gene Name: murine retrovirus integration site 1 homolog
  Uniprot ID: Q9Y6F6
  ENSP ID: ENSP00000437784
MVKAPQSEERLARGGKENNSVLACGAQASWSIFGADAAEVPGTRGHSQQEAAMPHIPEDEEPPGEPQAAQSPAGQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQKGDEADVSSPHPGEPEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 53481 - protein, 597 aa, Homo sapiens; identical to SEQ ID NO: 53469
  Payload ID: 10623
  Gene Symbol: MRVI1
  Gene Name: murine retrovirus integration site 1 homolog
  Uniprot ID: Q9Y6F6
  ENSP ID: ENSP00000448278

SEQ ID NO: 53482 - protein, 597 aa, Homo sapiens; identical to SEQ ID NO: 53469
  Payload ID: 10623
  Gene Symbol: MRVI1
  Gene Name: murine retrovirus integration site 1 homolog
  Uniprot ID: Q9Y6F6
  ENSP ID: ENSP00000453013

SEQ ID NO: 53483 - protein, 551 aa, Homo sapiens
  Payload ID: 10624
  Gene Symbol: MUS81
  Gene Name: MUS81 structure-specific endonuclease subunit
  Uniprot ID: Q96NY9
  ENSP ID: ENSP00000307853
MAAPVRLGRKRPLPACPNPLFVRWLTEWRDEATRSRRRTRFVFQKALRSLRRYPLPLRSGKEAKILQHFGDGLCRMLDERLQRHRTSGGDHAPDSPSGENSPAPQGRLAEVQDSSMPVPAQPKAGGSGSYWPARHSGARVILLVLYREHLNPNGHHFLTKEELLQRCAQKSPRVAPGSARPWPALRSLLHRNLVLRTHQPARYSLTPEGLELAQKLAESEGLSLLNVGIGPKEPPGEETAVPGAASAELASEAGVQQQPLELRPGEYRVLLCVDIGETRGGGHRPELLRELQRLHVTHTVRKLHVGDFVWVAQETNPRDPANPGELVLDHIVERKRLDDLCSSIIDGRFREQKFRLKRCGLERRVYLVEEHGSVHNLSLPESTLLQAVTNTQVIDGFFVKRTADIKESAAYLALLTRGLQRLYQGHTLRSRPWGTPGNPESGAMTSPNPLCSLLTFSDFNAGAIKNKAQSVREVFARQLMQVRGVSGEKAAALVDRYSTPASLLAAYDACATPKEQETLLSTIKCGRLQRNLGPALSRTLSQLYCSYGPLT

SEQ ID NO: 53484 - protein, 135 aa, Homo sapiens
  Payload ID: 10624
  Gene Symbol: MUS81
  Gene Name: MUS81 structure-specific endonuclease subunit
  ENSP ID: ENSP00000431478
MLDERLQRHRTSGGDHAPDSPSGENSPAPQGRLAEVQDSSMPVPAQPKAGGSGSYWPARHSGARVILLVLYREHLNPNGHHFLTKEELLQRCAQKSPRVAPGSARPWPALRSLLHRNLVLRTHQPARYSLTPEGL

SEQ ID NO: 53485 - protein, 202 aa, Homo sapiens
  Payload ID: 10624
  Gene Symbol: MUS81
  Gene Name: MUS81 structure-specific endonuclease subunit
  ENSP ID: ENSP00000431979
MHGPRLSWTLFKTSLHLQPPSSLRLKLTILRDLRAAKLRCSNPDSRTGGVPVPRAWSAGGPALGLMAAPVRLGRKRPLPACPNPLFVRWLTEWRDEATRSRRRTRFVFQKALRSLRRYPLPLRSGKEAKILQHFGDGLCRMLDERLQRHRTSGGDHAPDSPSGENSPAPQGRLAEVQDSSMPVPAQPKAGGSGSYWPARHSG

SEQ ID NO: 53486 - protein, 476 aa, Homo sapiens
  Payload ID: 10624
  Gene Symbol: MUS81
  Gene Name: MUS81 structure-specific endonuclease subunit
  ENSP ID: ENSP00000432287
MLDERLQRHRTSGGDHAPDSPSGENSPAPQGRLAEVQDSSMPVPAQPKAGGSGSYWPARHSGARVILLVLYREHLNPNGHHFLTKEELLQRCAQKSPRVAPGSARPWPALRSLLHRNLVLRTHQPARYSLTPEGLELAQKLAESEGLSLLNVGIGPKEPPGEETAVPGAASAELASEAGVQQQPLELRPGEYRVLLCVDIGETRGGGHRPELLRELQRLHVTHTVRKLHVGDFVWVAQETNPRDPANPGELVLDHIVERKRLDDLCSSIIDGRFREQKFRLKRCGLERRVYLVEEHGSVHNLSLPESTLLQAVTNTQVIDGFFVKRTADIKESAAYLALLTRGLQRLYQGHTLRSRPWGTPGNPESGAMTSPNPLCSLLTFSDFNAGAIKNKAQSVREVFARQLMQVRGVSGEKAAALVDRYSTPASLLAAYDACATPKEQETLLSTIKCGRLQRNLGPALSRTLSQLYCSYGPLT

SEQ ID NO: 53487 - protein, 389 aa, Homo sapiens
  Payload ID: 10624
  Gene Symbol: MUS81
  Gene Name: MUS81 structure-specific endonuclease subunit
  ENSP ID: ENSP00000433473
  MOD_RES (1)..(1): Any amino acid
XRRTRFVFQKALRSLRRYPLPLRSGKEAKILQHFGDGLCRMLDERLQRHRTSGGDHAPDSPSGENSPAPQGRLAEVQDSSMPVPAQPKAGGSGSYWPARHSGARVILLVLYREHLNPNGHHFLTKEELLQRCAQKSPRVAPGSARPWPALRSLLHRNLVLRTHQPARYSLTPEGLELAQKLAESEGLSLLNVGIGPKEPPGEETAVPGAASAELASEAGVQQQPLELRPGEYRVLLCVDIGETRGGGHRPELLRELQRLHVTHTVRKLHVGDFVWVAQETNPRDPANPGELVLDHIVERKRLDDLCSSIIDGRFREQKFRLKRCGLERRVYLVEEHGSVHNLSLPESTLLQAVTNTQVIDGFFVKRTADIKESAAYLALLTRGLQRLYQ

SEQ ID NO: 53488 - protein, 231 aa, Homo sapiens
  Payload ID: 10624
  Gene Symbol: MUS81
  Gene Name: MUS81 structure-specific endonuclease subunit
  ENSP ID: ENSP00000433809
  MOD_RES (1)..(1): Any amino acid
XGRLAEVQDSSMPVPAQPKAGGSGSYWPARHSGARVILLVLYREHLNPNGHHFLTKEELLQRCAQKSPRVAPGSARPWPALRSLLHRNLVLRTHQPARYSLTPEGLELAQKLAESEGLSLLNVGIGPKEPPGEETAVPGAASAELASEAGVQQQPLELRPGEYRVLLCVDIGETRGLPSLPLQGRAQAGAAPRATAAARDPHANPGELVLDHIVERKRLDDLCSSIIDGRF

SEQ ID NO: 53489 - protein, 411 aa, Homo sapiens
  Payload ID: 10624
  Gene Symbol: MUS81
  Gene Name: MUS81 structure-specific endonuclease subunit
  ENSP ID: ENSP00000434305
  MOD_RES (1)..(1): Any amino acid
XLDERLQRHRTSGGDHAPDSPSGENSPAPQGRLAEVQDSSMPVPAQPKAGGSGSYWPARHSGARVILLVLYREHLNPNGHHFLTKEELLQRCAQKSPRVAPGSARPWPALRSLLHRNLVLRTHQPARYSLTPEGLELAQKLAESEGLSLLNVGIGPKEPPGEETAVPGAASAELASEAGVQQQPLELRPGEYRVLLCVDIGETRGGGHRPELLRELQRLHVTHTVRKLHVGDFVWVAQETNPRDPAANPGELVLDHIVERKRLDDLCSSIIDGRFREQKFRLKRCGLERRVYLVEEHGSVHNLSLPESTLLQAVTNTQVIDGFFVKRTADIKESAAYLALLTRGLQRLYQGHTLRSRPWGTPGNPESGAMTSPNPLCSLLTFSDFNAGAIKNKAQSVREVFARQLMQVRGV

SEQ ID NO: 53490 - protein, 63 aa, Homo sapiens
  Payload ID: 10624
  Gene Symbol: MUS81
  Gene Name: MUS81 structure-specific endonuclease subunit
  ENSP ID: ENSP00000435277
AQSVREVFARQLMQVRGVSGEKAAALVDRYSTPASLLAAYDACATPKEQETLLSTIKCGRLQR

SEQ ID NO: 53491 - protein, 362 aa, Homo sapiens
  Payload ID: 10625
  Gene Symbol: MSI1
  Gene Name: musashi RNA-binding protein 1
  Uniprot ID: O43347
  ENSP ID: ENSP00000257552
METDAPQPGLASPDSPHDPCKMFIGGLSWQTTQEGLREYFGQFGEVKECLVMRDPLTKRSRGFGFVTFMDQAGVDKVLAQSRHELDSKTIDPKVAFPRRAQPKMVTRTKKIFVGGLSVNTTVEDVKQYFEQFGKVDDAMLMFDKTTNRHRGFGFVTFESEDIVEKVCEIHFHEINNKMVECKKAQPKEVMSPTGSARGRSRVMPYGMDAFMLGIGMLGYPGFQATTYASRSYTGLAPGYTYQFPEFRVERTPLPSAPVLPELTAIPLTAYGPMAAAAAAAAVVRGTGSHPWTMAPPPGSTPSRTGGFLGTTSPGPMAELYGAANQDSGVSSYISAASPAPSTGFGHSLGGPLIATAFTNGYH

SEQ ID NO: 53492 - protein, 233 aa, Homo sapiens
  Payload ID: 10625
  Gene Symbol: MSI1
  Gene Name: musashi RNA-binding protein 1
  ENSP ID: ENSP00000446710
  MOD_RES (1)..(1): Any amino acid
XDQAGVDKVLAQSRHELDSKTIDPKVAFPRRAQPKMVTRTKKIFVGGLSVNTTVEDVKQYFEQFGKVDDAMLMFDKTTNRHRGFGFVTFESEDIVEKVCEIHFHEINNKMVECKKAQPKEVMSPTGSARGRSRVMPYGMDAFMLGIGMLGYPGFQATTYASRSYTGLAPGYTYQFPAIPLTAYGPMAAAAAAAAVVRGTGSHPWTMAPPPGSTPSRTGGFLGTTSPGPMAELY

SEQ ID NO: 53493 - protein, 328 aa, Homo sapiens
  Payload ID: 10626
  Gene Symbol: MSI2
  Gene Name: musashi RNA-binding protein 2
  Uniprot ID: Q96DH6
  ENSP ID: ENSP00000284073
MEANGSQGTSGSANDSQHDPGKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPGFPAAAYGPVAAAAVAAARGSGSNPARPGGFPGANSPGPVADLYGPASQDSGVGNYISAASPQPGSGFGHGIAGPLIATAFTNGYH

SEQ ID NO: 53494 - protein, 251 aa, Homo sapiens
  Payload ID: 10626
  Gene Symbol: MSI2
  Gene Name: musashi RNA-binding protein 2
  Uniprot ID: Q96DH6
  ENSP ID: ENSP00000313616
MADLTSVLTSVMFSPSSKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPDYLPVSQDIIFIN

SEQ ID NO: 53495 - protein, 267 aa, Homo sapiens
  Payload ID: 10626
  Gene Symbol: MSI2
  Gene Name: musashi RNA-binding protein 2
  ENSP ID: ENSP00000392607
MMRGYIKKVLKNTSYHVNQYLFIQHGWSGSGDQSVLYSCNLMRMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPGFPAAAYGPVAAAAVAAARGSGSNPARPGGFPGANSPGPVADLYGPASQDSGVGNYISAASPQPGSGFGHGIAGPLIATAFTNGYH

SEQ ID NO: 53496 - protein, 324 aa, Homo sapiens
  Payload ID: 10626
  Gene Symbol: MSI2
  Gene Name: musashi RNA-binding protein 2
  ENSP ID: ENSP00000414671
MFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPGFPAAAYGPVAAAAVAAARGSVLNSYSAQPNFGAPASPAGSNPARPGGFPGANSPGPVADLYGPASQDSGVGNYISAASPQPGSGFGHGIAGPLIATAFTNGYH

SEQ ID NO: 53497 - protein, 151 aa, Homo sapiens
  Payload ID: 10626
  Gene Symbol: MSI2
  Gene Name: musashi RNA-binding protein 2
  Uniprot ID: Q96DH6
  ENSP ID: ENSP00000462264
MVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPDYLPVSQDIIFIN

SEQ ID NO: 53498 - protein, 140 aa, Homo sapiens
  Payload ID: 10626
  Gene Symbol: MSI2
  Gene Name: musashi RNA-binding protein 2
  ENSP ID: ENSP00000462914
MADLTSVLTSVMFSPSSKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVSAGSPGLS

SEQ ID NO: 53499 - protein, 99 aa, Homo sapiens
  Payload ID: 10626
  Gene Symbol: MSI2
  Gene Name: musashi RNA-binding protein 2
  ENSP ID: ENSP00000463227
MEANGSQGTSGSANDSQHDPGKMFIGGLSWQTSPDSLRDYFSKFGEIRECMVMRDPTTKRSRGFGFVTFADPASVDKVLGQPHHELDSKTCRRQKRLVY

SEQ ID NO: 53500 - protein, 208 aa, Homo sapiens [sequence omitted]

SEQ ID NO: 53501 - protein, 208 aa, Homo sapiens [sequence omitted]

SEQ ID NO: 53502 - protein, 23 aa, Homo sapiens
  Payload ID: 10627
  Gene Symbol: MRAS
  Gene Name: muscle RAS oncogene homolog
  ENSP ID: ENSP00000417092
MATSAVPSDNLPTYKLVVVGDGG

SEQ ID NO: 53503 - protein, 107 aa, Homo sapiens
  Payload ID: 10627
  Gene Symbol: MRAS
  Gene Name: muscle RAS oncogene homolog
  ENSP ID: ENSP00000417685
MREQYMRTGDGFLIVYSVTDKASFEHVDRFHQLILRVKDRESFPMILVANKVDLMHLRKITREQGKEMATKHNIPYIETSAKDPPLNVDKAFHDLVRVIRQQIPEKS

SEQ ID NO: 53504 - protein, 208 aa, Homo sapiens [sequence omitted]

SEQ ID NO: 53505 - protein, 132 aa, Homo sapiens
  Payload ID: 10627
  Gene Symbol: MRAS
  Gene Name: muscle RAS oncogene homolog
  Uniprot ID: O14807
  ENSP ID: ENSP00000419582
MREQYMRTGDGFLIVYSVTDKASFEHVDRFHQLILRVKDRESFPMILVANKVDLMHLRKITREQGKEMATKHNIPYIETSAKDPPLNVDKAFHDLVRVIRQQIPEKSQKKKKKTKWRGDRATGTHKLQCVIL

SEQ ID NO: 53506 - protein, 132 aa, Homo sapiens; identical to SEQ ID NO: 53505
  Payload ID: 10627
  Gene Symbol: MRAS
  Gene Name: muscle RAS oncogene homolog
  Uniprot ID: O14807
  ENSP ID: ENSP00000481637

SEQ ID NO: 53507 - protein, 132 aa, Homo sapiens; identical to SEQ ID NO: 53505
  Payload ID: 10627
  Gene Symbol: MRAS
  Gene Name: muscle RAS oncogene homolog
  Uniprot ID: O14807
  ENSP ID: ENSP00000484586

SEQ ID NO: 53508 - protein, 783 aa, Homo sapiens
  Payload ID: 10628
  Gene Symbol: MUSK
  Gene Name: muscle, skeletal, receptor tyrosine kinase
  Uniprot ID: O15146
  ENSP ID: ENSP00000189978
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEEESEPEQDTKVFARILRAPESHNVTFGSFVTLHCTATGIPVPTITWIENGNAVSSGSIQESVKDRVIDSRLQLFITKPGLYTCIATNKHGEKFSTAKAAATISIAEWREYCLAVKELFCAKEWLVMEEKTHRGLYRSEMHLLSVPECSKLPSMHWDPTACARLPHLAFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 53509 - protein, 132 aa, Homo sapiens
  Payload ID: 10628
  Gene Symbol: MUSK
  Gene Name: muscle, skeletal, receptor tyrosine kinase
  ENSP ID: ENSP00000363562
NGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEGAKGIHTQFVASALQLRSFLSCPQI

SEQ ID NO: 53510 - protein, 783 aa, Homo sapiens [sequence omitted]

SEQ ID NO: 53511 - protein, 869 aa, Homo sapiens
  Payload ID: 10628
  Gene Symbol: MUSK
  Gene Name: muscle, skeletal, receptor tyrosine kinase
  Uniprot ID: O15146
  ENSP ID: ENSP00000363571
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEWSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 53512 - protein, 861 aa, Homo sapiens
  Payload ID: 10628
  Gene Symbol: MUSK
  Gene Name: muscle, skeletal, receptor tyrosine kinase
  ENSP ID: ENSP00000393608
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEWSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLAFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 53513 - protein, 388 aa, Homo sapiens
  Payload ID: 10629
  Gene Symbol: MBNL1
  Gene Name: muscleblind-like splicing regulator 1
  Uniprot ID: Q9NR56
  ENSP ID: ENSP00000282486
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 53514 - protein, 400 aa, Homo sapiens
  Payload ID: 10629
  Gene Symbol: MBNL1
  Gene Name: muscleblind-like splicing regulator 1
  ENSP ID: ENSP00000282488
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 53515 - protein, 340 aa, Homo sapiens
  Payload ID: 10629
  Gene Symbol: MBNL1
  Gene Name: muscleblind-like splicing regulator 1
  Uniprot ID: Q9NR56
  ENSP ID: ENSP00000319374
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMFPWCTVLRQPLCPQQQHLPQVFPSLQQPQPTSPILDASTLLGATSCPAAAGKMIPIISAEHLTSHKYVTQM

SEQ ID NO: 53516 - protein, 382 aa, Homo sapiens
  Payload ID: 10629
  Gene Symbol: MBNL1
  Gene Name: muscleblind-like splicing regulator 1
  Uniprot ID: Q9NR56
  ENSP ID: ENSP00000319429
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 53517 - protein, 370 aa, Homo sapiens
  Payload ID: 10629
  Gene Symbol: MBNL1
  Gene Name: muscleblind-like splicing regulator 1
  Uniprot ID: Q9NR56
  ENSP ID: ENSP00000347637
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 53518 - protein, 342 aa, Homo sapiens
  Payload ID: 10629
  Gene Symbol: MBNL1
  Gene Name: muscleblind-like splicing regulator 1
  Uniprot ID: Q9NR56
  ENSP ID: ENSP00000350064
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVDTHNICRTSD

SEQ ID NO: 53519 - protein, 58 aa, Homo sapiens
  Payload ID: 10629
  Gene Symbol: MBNL1
  Gene Name: muscleblind-like splicing regulator 1
  ENSP ID: ENSP00000417169
MLGRCSRENCKYLHPPPHLKTQLEINGRNNLIQQKNMAMLAQQMQLANAMMPGAPLQP

SEQ ID NO: 53520 - protein, 314 aa, Homo sapiens
  Payload ID: 10629
  Gene Symbol: MBNL1
  Gene Name: muscleblind-like splicing regulator 1
  Uniprot ID: Q9NR56
  ENSP ID: ENSP00000417630
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 53521 - protein, 90 aa, Homo sapiens
  Payload ID: 10629
  Gene Symbol: MBNL1
  Gene Name: muscleblind-like splicing regulator 1
  ENSP ID: ENSP00000417741
MAMLAQQMQLANAMMPGAPLQPVPMFSVAPSLATNASAAAFNPYLGPVSPSLVPAEILPTAPMLVTGNPGVPVPAAAAAAAQKLMRTDRL

SEQ ID NO: 53522 - protein, 388 aa, Homo sapiens; identical to SEQ ID NO: 53513
  Payload ID: 10629
  Gene Symbol: MBNL1
  Gene Name: muscleblind-like splicing regulator 1
  Uniprot ID: Q9NR56
  ENSP ID: ENSP00000418108

SEQ ID NO: 53523 - protein, 329 aa, Homo sapiens
  Payload ID: 10629
  Gene Symbol: MBNL1
  Gene Name: muscleblind-like splicing regulator 1
  ENSP ID: ENSP00000418109
  MOD_RES (1)..(1): Any amino acid
XVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPDTHNICRTSD

SEQ ID NO: 53524 - protein, 302 aa, Homo sapiens
  Payload ID: 10629
  Gene Symbol: MBNL1
  Gene Name: muscleblind-like splicing regulator 1
  Uniprot ID: Q9NR56
  ENSP ID: ENSP00000418427
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 53525 - protein, 210 aa, Homo sapiens
  Payload ID: 10629
  Gene Symbol: MBNL1
  Gene Name: muscleblind-like splicing regulator 1
  ENSP ID: ENSP00000418508
QQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMALANMQLQQHTAFLPPGSILCMTPATSVDTHNICRTSD

SEQ ID NO: 53526 - protein, 340 aa, Homo sapiens; identical to SEQ ID NO: 53515
  Payload ID: 10629
  Gene Symbol: MBNL1
  Gene Name: muscleblind-like splicing regulator 1
  Uniprot ID: Q9NR56
  ENSP ID: ENSP00000418876

SEQ ID NO: 53527 - protein, 343 aa, Homo sapiens
  Payload ID: 10629
  Gene Symbol: MBNL1
  Gene Name: muscleblind-like splicing regulator 1
  ENSP ID: ENSP00000419347
MGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 53528 - protein, 342 aa, Homo sapiens; identical to SEQ ID NO: 53518
  Payload ID: 10629
  Gene Symbol: MBNL1
  Gene Name: muscleblind-like splicing regulator 1
  Uniprot ID: Q9NR56
  ENSP ID: ENSP00000420103

SEQ ID NO: 53529 - protein, 348 aa, Homo sapiens
  Payload ID: 10629
  Gene Symbol: MBNL1
  Gene Name: muscleblind-like splicing regulator 1
  ENSP ID: ENSP00000420327
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPDTHNICRTSD

SEQ ID NO: 53530 - protein, 155 aa, Homo sapiens
  Payload ID: 10629
  Gene Symbol: MBNL1
  Gene Name: muscleblind-like splicing regulator 1
  ENSP ID: ENSP00000420680
MAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKI

SEQ ID NO: 53531 - protein, 314 aa, Homo sapiens; identical to SEQ ID NO: 53520
  Payload ID: 10629
  Gene Symbol: MBNL1
  Gene Name: muscleblind-like splicing regulator 1
  Uniprot ID: Q9NR56
  ENSP ID: ENSP00000437491

SEQ ID NO: 53532 - protein, 367 aa, Homo sapiens
  Payload ID: 10630
  Gene Symbol: MBNL2
  Gene Name: muscleblind-like splicing regulator 2
  Uniprot ID: Q5VZF2
  ENSP ID: ENSP00000267287
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTGSVLCMTPATSIVPMMHSATSATVSAATTPATSVPFAATATANQIILK

SEQ ID NO: 53533 - protein, 361 aa, Homo sapiens
  Payload ID: 10630
  Gene Symbol: MBNL2
  Gene Name: muscleblind-like splicing regulator 2
  Uniprot ID: Q5VZF2
  ENSP ID: ENSP00000344214
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTDNSEIISRNGMECQESALRITKHCYCTYYPVSSSIELPQTAC

SEQ ID NO: 53534 - protein, 373 aa, Homo sapiens
  Payload ID: 10630
  Gene Symbol: MBNL2
  Gene Name: muscleblind-like splicing regulator 2
  Uniprot ID: Q5VZF2
  ENSP ID: ENSP00000365861
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQHQANQAAVAAQAAAAAATVMAFPPGALHPLPKRQALEKSNGTSAVFNPSVLHYQQALTSAQLQQHAAFIPTGSVLCMTPATSIDNSEIISRNGMECQESALRITKHCYCTYYPVSSSIELPQTAC

SEQ ID NO: 53535 - protein, 361 aa, Homo sapiens; identical to SEQ ID NO: 53533
  Payload ID: 10630
  Gene Symbol: MBNL2
  Gene Name: muscleblind-like splicing regulator 2
  Uniprot ID: Q5VZF2
  ENSP ID: ENSP00000380726

SEQ ID NO: 53536 - protein, 105 aa, Homo sapiens
  Payload ID: 10630
  Gene Symbol: MBNL2
  Gene Name: muscleblind-like splicing regulator 2
  ENSP ID: ENSP00000404202
TQSTAKAMKRPLEATVDLAFPPGALHPLPKRQALEKSNGTSAVFNPSVLHYQQALTSAQLQQHAAFIPTVPMMHSATSATVSAATTPATSVPFAATATANQIILK

SEQ ID NO: 53537 - protein, 255 aa, Homo sapiens
  Payload ID: 10630
  Gene Symbol: MBNL2
  Gene Name: muscleblind-like splicing regulator 2
  ENSP ID: ENSP00000432422
MALNVAPVRDTKWLTLEVCRQFQRGTCSRSDEECKFAHPPKSCQVENGRVIACFDSLKGRCSRENCKYLHPPTHLKTQLEINGRNNLIQQKTAAAMLAQQMQFMFPGTPLHPVPTFPVGPAIGTNTAISFAPYLAPVTPGVGLVPTEILPTTPVIVPGSPPVTVPGSTATQKLLRTDKLEVCREFQRGNCARGETDCRFAHPADSTMIDTSDNTVTVCMDYIKGRCMREKCKYFHPPAHLQAKIKAAQPRPRPQS

SEQ ID NO: 53538 - protein, 334 aa, Homo sapiens
  Payload ID: 10631
  Gene Symbol: MBNL3
  Gene Name: muscleblind-like splicing regulator 3
  Uniprot ID: Q9NUK0
  ENSP ID: ENSP00000359876
MTAVNVALIRDTKWLTLEVCREFQRGTCSRADADCKFAHPPRVCHVENGRVVACFDSLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALTNLQLPQPAFIPAGPILCMAPASNIVPMMHGATPTTVSAATTPATSVPFAAPTTGNQIPQLSIDELNSSMFVSQM

SEQ ID NO: 53539 - protein, 258 aa, Homo sapiens
  Payload ID: 10631
  Gene Symbol: MBNL3
  Gene Name: muscleblind-like splicing regulator 3
  Uniprot ID: Q9NUK0
  ENSP ID: ENSP00000359881
MFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQLKF

SEQ ID NO: 53540 - protein, 304 aa, Homo sapiens
  Payload ID: 10631
  Gene Symbol: MBNL3
  Gene Name: muscleblind-like splicing regulator 3
  Uniprot ID: Q9NUK0
  ENSP ID: ENSP00000359886
MERASKNLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQLKF

SEQ ID NO: 53541 - protein, 354 aa, Homo sapiens
  Payload ID: 10631
  Gene Symbol: MBNL3
  Gene Name: muscleblind-like splicing regulator 3
  Uniprot ID: Q9NUK0
  ENSP ID: ENSP00000359890
MTAVNVALIRDTKWLTLEVCREFQRGTCSRADADCKFAHPPRVCHVENGRVVACFDSLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQLKF

SEQ ID NO: 53542 - protein, 342 aa, Homo sapiens
  Payload ID: 10631
  Gene Symbol: MBNL3
  Gene Name: muscleblind-like splicing regulator 3
  ENSP ID: ENSP00000359894
MTAVNVALIRDTKWLTLEVCREFQRGTCSRADADCKFAHPPRVCHVENGRVVACFDSLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAVPMMHGATPTTVSAATTPATSVPFAAPTTGNQLKF

SEQ ID NO: 53543 - protein, 258 aa, Homo sapiens; identical to SEQ ID NO: 53539
  Payload ID: 10631
  Gene Symbol: MBNL3
  Gene Name: muscleblind-like splicing regulator 3
  Uniprot ID: Q9NUK0
  ENSP ID: ENSP00000377848

SEQ ID NO: 53544 - protein, 223 aa, Homo sapiens
  Payload ID: 10631
  Gene Symbol: MBNL3
  Gene Name: muscleblind-like splicing regulator 3
  ENSP ID: ENSP00000402128
MFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNI

SEQ ID NO: 53545 - protein, 242 aa, Homo sapiens
  Payload ID: 10631
  Gene Symbol: MBNL3
  Gene Name: muscleblind-like splicing regulator 3
  ENSP ID: ENSP00000406014
MFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPA

SEQ ID NO: 53546 - protein, 150 aa, Homo sapiens
  Payload ID: 10631
  Gene Symbol: MBNL3
  Gene Name: muscleblind-like splicing regulator 3
  ENSP ID: ENSP00000412065
IKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQIPQLSIDELNSSMFVSQM

SEQ ID NO: 53547 - protein, 292 aa, Homo sapiens
  Payload ID: 10631
  Gene Symbol: MBNL3
  Gene Name: muscleblind-like splicing regulator 3
  Uniprot ID: Q9NUK0
  ENSP ID: ENSP00000439618
MERASKNLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAVPMMHGATPTTVSAATTPATSVPFAAPTTGNQLKF

SEQ ID NO: 53548 - protein, 364 aa, Homo sapiens
  Payload ID: 10632
  Gene Symbol: MURC
  Gene Name: muscle-related coiled-coil protein
  Uniprot ID: Q5BKX8
  ENSP ID: ENSP00000418668
MEHNGSASNADKIHQNRLSSVTEDEDQDAALTIVTVLDKVASIVDSVQASQKRIEERHREMENAIKSVQIDLLKLSQSHSNTGHIINKLFEKTRKVSAHIKDVKARVEKQQIHVKKVEVKQEEIMKKNKFRVVIFQEKFRCPTSLSVVKDRNLTENQEEDDDDIFDPPVDLSSDEEYYVEESRSARLRKSGKEHIDNIKKAFSKENMQKTRQNLDKKVNRIRTRIVTPERRERLRQSGERLRQSGERLRQSGERFKKSISNAAPSKEAFKMRSLRKGKDRTVAEGEECAREMGVDIIARSESLGPISELYSDELSEPEHEAARPVYPPHEGREIPTPEPLKVTFKSQVKVEDDESLLLDLKHSS

SEQ ID NO: 53549 - protein, 458 aa, Homo sapiens
  Payload ID: 10633
  Gene Symbol: MLIP
  Gene Name: muscular LMNA-interacting protein
  Uniprot ID: Q5VWP3
  ENSP ID: ENSP00000274897
MELEKREKRSLLNKNLEEKLTVSAGGSEAKPLIFTFVPTVRRLPTHTQLADTSKFLVKIPEESSDKSPETVNRSKSNDYLTLNAGSQQERDQAKLTCPSEVSGTILQEREFEANKLQGMQQSDLFKAEYVLIVDSEGEDEAASRKVEQGPPGGIGTAAVRPKSLAISSSLVSDVVRPKTQGTDLKTSSHPEMLHGMAPQQKHGQQYKTKSSYKAFAAIPTNTLLLEQKALDEPAKTESVSKDNTLEPPVELYFPAQLRQQTEELCATIDKVLQDSLSMHSSDSPSRSPKTLLGSDTVKTPTTLPRAAGRETKYANLSSPSSTVSESQLTKPGVIRPVPVKSRILLKKEEEVYEPNPFSKYLEDNSDLFSEQDVTVPPKPVSLHPLYQTKLYPPAKSLLHPQTLSHADCLAPGPFSHLSFSLSDEQENSHTLLSHNACNKLSHPMVAIPEHEALDSKEQ

SEQ ID NO: 53550 - protein, 234 aa, Homo sapiens
  Payload ID: 10633
  Gene Symbol: MLIP
  Gene Name: muscular LMNA-interacting protein
  Uniprot ID: Q5VWP3
  ENSP ID: ENSP00000359913
MCSWYLGFECSSKSNDYLTLNAGSQQERDQAKLTCPSEVSGTILQEREFEANKLQGMQQSDLFKAEYVLIVDSEGEDEAASRKVEQGPPGGIGTAAVRPKSLAISSSLVSDVVRPKTQGTDLKTSSHPEMLHGMAPQQKHGQTPTTLPRAAGRETKYANLSSPSSTVSESQLTKPGVIRPVPVKSRILLKKEEEVYEPNPFSKYLEDNSDLFSEQLSHPMVAIPEHEALDSKEQ

SEQ ID NO: 53551 - protein, 268 aa, Homo sapiens
  Payload ID: 10633
  Gene Symbol: MLIP
  Gene Name: muscular LMNA-interacting protein
  ENSP ID: ENSP00000359914
MELEKREKRSLLNKNLEEKLTSKSNDYLTLNAGSQQERDQAKLTCPSEVSGTILQEREFEANKLQGMQQSDLFKAEYVLIVDSEGEDEAASRKVEQGPPGGIGTAAVRPKSLAISSSLVSDVVRPKTQGTDLKTSSHPEMLHGMAPQQKHGQALDEPAKTESVSKDNTLEPPVEHSSDSPSRSPKTLLGSDTVKTPTTLPRAAGRETKYANLSSPSSTVSESQLTKPGVIRPVPVKSRILLKKEEEVYEPNPFSKYLEDNSDLFSEQQ

SEQ ID NO: 53552 - protein, 196 aa, Homo sapiens
  Payload ID: 10633
  Gene Symbol: MLIP
  Gene Name: muscular LMNA-interacting protein
  ENSP ID: ENSP00000411917
MQQSDLFKAEYVLIVDSEGEDEAASRKVEQGPPGGIGTAAVRPKSLAISSSLVSDVVRPKTQGTDLKTSSHPEMLHGMAPQQKHGQQYKTKSSYKAFAAIPTNTLLLEQKALDEPAKTESVSKDNTLEPPVETPTTLPRAAGRETKYANLSSPSSTVSESQLTKPGVIRPVPVKSRILLKKEEEVYEPNPFSKYLE

SEQ ID NO: 53553 - protein, 329 aa, Homo sapiens
  Payload ID: 10633
  Gene Symbol: MLIP
  Gene Name: muscular LMNA-interacting protein
  ENSP ID: ENSP00000421444
CGNNYFQMTSCILSGSIQTTPQVSAGGSEAKPLIFTFVPTVRRLPTHTQLADTSKFLVKIPEESSDKSPETVNRSKSNDYLTLNAGSQQERDQAKLTCPSEVSGTILQEREFEANKLQGMQQSDLFKAEYVLIVDSEGEDEAASRKVEQGPPGGIGTAAVRPKSLAISSSLVSDVVRPKTQGTDLKTSSHPEMLHGMAPQQKHGQALDEPAKTESVSKDNTLEPPVETPTTLPRAAGRETKYANLSSPSSTVSESQLTKPGVIRPVPVKSRILLKKEEEVYEPNPFSKYLEDNSDLFSEQDVTVPPKPVSLHPLYQTKLYPPAKSLLHP

SEQ ID NO: 53554 - protein, 3 aa, Homo sapiens
  Payload ID: 10633
  Gene Symbol: MLIP
  Gene Name: muscular LMNA-interacting protein
  ENSP ID: ENSP00000421727
MQQ

SEQ ID NO: 53555 - protein, 110 aa, Homo sapiens
  Payload ID: 10633
  Gene Symbol: MLIP
  Gene Name: muscular LMNA-interacting protein
  ENSP ID: ENSP00000423191
MSTPSPTMAACLRLDACQQESTVLEPGSPDFADESTLKCASFWKVNHVITSKSNDYLTLNAGSQQERDQAKLTCPSEVSGTILQEREFEANKLQGMQQSDLFKAEYVLIV

SEQ ID NO: 53556 - protein, 915 aa, Homo sapiens
  Payload ID: 10633
  Gene Symbol: MLIP
  Gene Name: muscular LMNA-interacting protein
  Uniprot ID: Q5VWP3
  ENSP ID: ENSP00000425142
MELEKREKRSLLNKNLEEKLTVSAGGSEAKPLIFTFVPTVRRLPTHTQLADTSKFLVKIPEESSDKSPETVNRSKSNDYLTLNAGSQQERDQAKLTCPSEVSGTILQEREFEANKLQGMQQSDLFKAEYVLIVDSEGEDEAASRKVEQGPPGGIGTAAVRPKSLAISSSLVSDVVRPKTQGTDLKTSSHPEMLHGMAPQQKHGQLTSSPTTSEQLACKPPAFSFVSPTNPNTPPDPVNLEGASVLEEFHTRRLDVGGAVVEESATYFQTTAHSTPFSASKGTSSTLLFPHSTQLSGSNLPSSTAADPKPGLTSEVLKKTTLTSHVLSHGESPRTSSSPPSSSASLKSNSASYIPVRIVTHSLSPSPKPFTSSFHGSSSTICSQMSSSGNLSKSGVKSPVPSRLALLTAILKSNPSHQRPFSPASCPTFSLNSPASSTLTLDQKEKQTPPTPKKSLSSCSLRAGSPDQGELQVSELTQQSFHLPVFTKSTPLSQAPSLSPTKQASSSLASMNVERTPSPTLKSNTMLSLLQTSTSSSVGLPPVPPSSSLSSLKSKQDGDLRGPENPRNIHTYPSTLASSALSSLSPPINQRATFSSSEKCFHPSPALSSLINRSKRASSQLSGQELNPSALPSLPVSSADFASLPNLRSSSLPHANLPTLVPQLSPSALHPHCGSGTLPSRLGKSESTTPNHRSPVSTPSLPISLTRTEELISPCALSMSTGPENKKSKQYKTKSSYKAFAAIPTNTLLLEQKALDEPAKTESVSKDNTLEPPVELYFPAQLRQQTEELCATIDKVLQDSLSMHSSDSPSRSPKTLLGSDTVKTPTTLPRAAGRETKYANLSSPSSTVSESQLTKPGVIRPVPVKSRILLKKEEEVYEPNPFSKYLEDNSDLFSEQAAHSVDSYCNGSDTSGPWLL

SEQ ID NO: 53557 - protein, 993 aa, Homo sapiens
  Payload ID: 10633
  Gene Symbol: MLIP
  Gene Name: muscular LMNA-interacting protein
  Uniprot ID: Q5VWP3
  ENSP ID: ENSP00000426290
MLSEQGLLSDCGNNYFQMTSCILSGSIQTTPQVSAGGSEAKPLIFTFVPTVRRLPTHTQLADTSKFLVKIPEESSDKSPETVNRSKSNDYLTLNAGSQQERDQAKLTCPSEVSGTILQEREFEANKLQGMQQSDLFKAEYVLIVDSEGEDEAASRKVEQGPPGGIGTAAVRPKSLAISSSLVSDVVRPKTQGTDLKTSSHPEMLHGMAPQQKHGQLTSSPTTSEQLACKPPAFSFVSPTNPNTPPDPVNLEGASVLEEFHTRRLDVGGAVVEESATYFQTTAHSTPFSASKGTSSTLLFPHSTQLSGSNLPSSTAADPKPGLTSEVLKKTTLTSHVLSHGESPRTSSSPPSSSASLKSNSASYIPVRIVTHSLSPSPKPFTSSFHGSSSTICSQMSSSGNLSKSGVKSPVPSRLALLTAILKSNPSHQRPFSPASCPTFSLNSPASSTLTLDQKEKQTPPTPKKSLSSCSLRAGSPDQGELQVSELTQQSFHLPVFTKSTPLSQAPSLSPTKQASSSLASMNVERTPSPTLKSNTMLSLLQTSTSSSVGLPPVPPSSSLSSLKSKQDGDLRGPENPRNIHTYPSTLASSALSSLSPPINQRATFSSSEKCFHPSPALSSLINRSKRASSQLSGQELNPSALPSLPVSSADFASLPNLRSSSLPHANLPTLVPQLSPSALHPHCGSGTLPSRLGKSESTTPNHRSPVSTPSLPISLTRTEELISPCALSMSTGPENKKSKQYKTKSSYKAFAAIPTNTLLLEQKALDEPAKTESVSKDNTLEPPVELYFPAQLRQQTEELCATIDKVLQDSLSMHSSDSPSRSPKTLLGSDTVKTPTTLPRAAGRETKYANLSSPSSTVSESQLTKPGVIRPVPVKSRILLKKEEEVYEPNPFSKYLEDNSDLFSEQDVTVPPKPVSLHPLYQTKLYPPAKSLLHPQTLSHADCLAPGPFSHLSFSLSDEQENSHTLLSHNACNKLSHPMVAIPEHEALDSKEQ

SEQ ID NO: 53558 - protein, 561 aa, Homo sapiens
  Payload ID: 10633
  Gene Symbol: MLIP
  Gene Name: muscular LMNA-interacting protein
  ENSP ID: ENSP00000426830
MLSEQGLLSDCGNNYFQMTSCILSGSIQTTPQSKSNDYLTLNAGSQQERDQAKLTCPSEVSGTILQEREFEANKLQGMQQSDLFKAEYVLIVDSEGEDEAASRKVEQGPPGGIGTAAVRPKSLAISSSLVSDVVRPKTQGTDLKTSSHPEMLHGMAPQQKHGQLTSSPTTSEQLACKPPAFSFVSPTNPNTPPDPVNLEGASVLEEFHTRRLDVGGAVVEESATYFQTTAHSTPFSASKGTSSTLLFPHSTQLSGSNLPSSTAADPKPGLTSEVLKKTTLTSHVLSHGESPRTSSSPPSSSASLKSNSASYIPVRIVTHSLSPSPKPFTSSFHGSSSTICSQMSSSGNLSKSGVKSPVPSRLALLTAILKSNPSHQRPFSPASCPTFSLNSPASSTLTLDQKEKQTPPTPKKSLSSCSLRAGSPDQGELQVSELTQQSFHLPVFTKSTPLSQAPSLSPTKQASSSLASMNVERTPSPTLKSNTMLSLLQTSTSSSVGLPPVPPSSSLSSLKSKQDGDLRGPENPRNIHTYPSTLASSALSSLSPPINQRATFSSSEKCFHP

SEQ ID NO: 53559 - protein, 123 aa, Homo sapiens
  Payload ID: 10633
  Gene Symbol: MLIP
  Gene Name: muscular LMNA-interacting protein
  ENSP ID: ENSP00000427057
MQQSDLFKAEYVLIVDSEGEDEAASRKVEQGPPGGIGTAAVRPKSLAISSSLVSDVVRPKTQGTDLKTSSHPEMLHGMAPQQKHGQLTSSPTTSEQLACKPPAFSFVSPTNPNTPPDPVNLEG

SEQ ID NO: 53560 - protein, 226 aa, Homo sapiens
  Payload ID: 10633
  Gene Symbol: MLIP
  Gene Name: muscular LMNA-interacting protein
  ENSP ID: ENSP00000427584
MELEKREKRSLLNKNLEEKLTSKSNDYLTLNAGSQQERDQAKLTCPSEVSGTILQEREFEANKLQGMQQSDLFKAEYVLIVDSEGEDEAASRKVEQGPPGGIGTAAVRPKSLAISSSLVSDVVRPKTQGTDLKTSSHPEMLHGMAPQQKHGQTPTTLPRAAGRETKYANLSSPSSTVSESQLTKPGVIRPVPVKSRILLKKEEEVYEPNPFSKYLEDNSDLFSEQQ

SEQ ID NO: 53561 - protein, 206 aa, Homo sapiens
  Payload ID: 10634
  Gene Symbol: MSC
  Gene Name: musculin
  Uniprot ID: O60682
  ENSP ID: ENSP00000321445
MSTGSVSDPEEMELRGLQREYPVPASKRPPLRGVERSYASPSDNSSAEEEDPDGEEERCALGTAGSAEGCKRKRPRVAGGGGAGGSAGGGGKKPLPAKGSAAECKQSQRNAANARERARMRVLSKAFSRLKTSLPWVPPDTKLSKLDTLRLASSYIAHLRQLLQEDRYENGYVHPVNLTWPFVVSGRPDSDTKEVSAANRLCGTTA

SEQ ID NO: 53562 - protein, 82 aa, Homo sapiens
  Payload ID: 10635
  Gene Symbol: MUSTN1
  Gene Name: musculoskeletal, embryonic nuclear protein 1
  Uniprot ID: Q8IVN3
  ENSP ID: ENSP00000410910
MSQAGAQEAPIKKKRPPVKDEDLKGARGNLTKNQEIKSKTYQVMRECEQAGSAAPSVFSRTRTGTETVFEKPKAGPTKSVFG

SEQ ID NO: 53563 - protein, 87 aa, Homo sapiens
  Payload ID: 10635
  Gene Symbol: MUSTN1
  Gene Name: musculoskeletal, embryonic nuclear protein 1
  ENSP ID: ENSP00000419877
MWLWWYSTAGAQEAPIKKKRPPVKDEDLKGARGNLTKNQEIKSKTYQVMRECEQAGSAAPSVFSRTRTGTETVFEKPKAGPTKSVFG

SEQ ID NO: 53564 - protein, 735 aa, Homo sapiens
  Payload ID: 10636
  Gene Symbol: MKLN1
  Gene Name: muskelin 1, intracellular mediator containing kelch motifs
  Uniprot ID: Q9UL63
  ENSP ID: ENSP00000323527
MAAGGAVAAAPECRLLPYALHKWSSFSSTYLPENILVDKPNDQSSRWSSESNYPPQYLILKLERPAIVQNITFGKYEKTHVCNLKKFKVFGGMNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNYTEAFESLQKKTKIALEHPMLTDIHDKLVLKGDFDACEELIEKAVNDGLFNQYISQQEYKPRWSQIIPKSTKGDGEDNRPGMRGGHQMVIDVQTETVYLFGGWDGTQDLADFWAYSVKENQWTCISRDTEKENGPSARSCHKMCIDIQRRQIYTLGRYLDSSVRNSKSLKSDFYRYDIDTNTWMLLSEDTAADGGPKLVFDHQMCMDSEKHMIYTFGGRILTCNGSVDDSRASEPQFSGLFAFNCQCQTWKLLREDSCNAGPEDIQSRIGHCMLFHSKNRCLYVFGGQRSKTYLNDFFSYDVDSDHVDIISDGTKKDSGMVPMTGFTQRATIDPELNEIHVLSGLSKDKEKREENVRNSFWIYDIVRNSWSCVYKNDQAAKDNPTKSLQEEEPCPRFAHQLVYDELHKVHYLFGGNPGKSCSPKMRLDDFWSLKLCRPSKDYLLRHCKYLIRKHRFEEKAQVDPLSALKYLQNDLYITVDHSDPEETKEFQLLASALFKSGSDFTALGFSDVDHTYAQRTQLFDTLVNFFPDSMTPPKGNLVDLITL

SEQ ID NO: 53565 - protein, 126 aa, Homo sapiens
  Payload ID: 10636
  Gene Symbol: MKLN1
  Gene Name: muskelin 1, intracellular mediator containing kelch motifs
  ENSP ID: ENSP00000387920
MNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNYTEAFESLQKKTKIALEHPMLTDIHDKLVL

SEQ ID NO: 53566 - protein, 643 aa, Homo sapiens
  Payload ID: 10636
  Gene Symbol: MKLN1
  Gene Name: muskelin 1, intracellular mediator containing kelch motifs
  ENSP ID: ENSP00000398094
MNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNYTEAFESLQKKTKIALEHPMLTDIHDKLVLKGDFDACEELIEKAVNDGLFNQYISQQEYKPRWSQIIPKSTKGDGEDNRPGMRGGHQMVIDVQTETVYLFGGWDGTQDLADFWAYSVKENQWTCISRDTEKENGPSARSCHKMCIDIQRRQIYTLGRYLDSSVRNSKSLKSDFYRYDIDTNTWMLLSEDTAADGGPKLVFDHQMCMDSEKHMIYTFGGRILTCNGSVDDSRASEPQFSGLFAFNCQCQTWKLLREDSCNAGPEDIQSRIGHCMLFHSKNRCLYVFGGQRSKTYLNDFFSYDVDSDHVDIISDGTKKDSGMVPMTGFTQRATIDPELNEIHVLSGLSKDKEKREENVRNSFWIYDIVRNSWSCVYKNDQAAKDNPTKSLQEEEPCPRFAHQLVYDELHKVHYLFGGNPGKSCSPKMRLDDFWSLKLCRPSKDYLLRHCKYLIRKHRFEEKAQVDPLSALKYLQNDLYITVDHSDPEETKEFQLLASALFKSGSDFTALGFSDVDHTYAQRTQLFDTLVNFFPDSMTPPKGNLVDLITL

SEQ ID NO: 53567 - protein, 78 aa, Homo sapiens
  Payload ID: 10636
  Gene Symbol: MKLN1
  Gene Name: muskelin 1, intracellular mediator containing kelch motifs
  ENSP ID: ENSP00000399954
MNEENMTELLSSGLKNDYNKETFTLKHKIDEQMFPCRFIKIVPLLSWGPSFNFSIWYVELSGIDDPDIVQPCLNWYSK

SEQ ID NO: 53568 - protein, 170 aa, Homo sapiens
  Payload ID: 10636
  Gene Symbol: MKLN1
  Gene Name: muskelin 1, intracellular mediator containing kelch motifs
  ENSP ID: ENSP00000407705
MAAGGAVAAAPECRLLPYALHKWSSFSSTYLPENILVDKPNDQSSRWSSESNYPPQYLILKLERPAIVQNITFGKYEKTHVCNLKKFKVFGGMNEENMTELLSSGLKNDYNKETFTLKHKIDEQMFPCRFIKIVPLLSWGPSFNFSIWYVELSGIDDPDIVQPCLNWYSK

SEQ ID NO: 53569 - protein, 97 aa, Homo sapiens
  Payload ID: 10636
  Gene Symbol: MKLN1
  Gene Name: muskelin 1, intracellular mediator containing kelch motifs
  ENSP ID: ENSP00000412815
MNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNY

SEQ ID NO: 53570 - protein, 829 aa, Homo sapiens
  Payload ID: 10637
  Gene Symbol: MCC
  Gene Name: mutated in colorectal cancers
  Uniprot ID: P23508
  ENSP ID: ENSP00000305617
MNSGVAMKYGNDSSAELSELHSAALASLKGDIVELNKRLQQTERERDLLEKKLAKAQCEQSHLMREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDKHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKECADAASPALSLAELRTTCSENELAAEFTNAIRREKKLKARVQELVSALERLTKSSEIRHQQSAEFVNDLKRANSNLVAAYEKAKKKHQNKLKKLESQMMAMVERHETQVRMLKQRIALLEEENSRPHTNETSL

SEQ ID NO: 53571 - protein, 1019 aa, Homo sapiens
  Payload ID: 10637
  Gene Symbol: MCC
  Gene Name: mutated in colorectal cancers
  Uniprot ID: P23508
  ENSP ID: ENSP00000386227
MMAAAAAAAAGSSSSGGGGGGSGSSSSSSDTSSTGEEERMRRLFQTCDGDGDGYISRNDLLMVCRQLNMEESVAEIMNQLGADENGKISFQDFTRCRMQLVREIRKEEVDLSAKSDNSCTKKLRDRIASWPTSSDNSLGALSAARESWEYDSGARDLQSPDVQSQSALQKLLEYGGSSLHQQAALHKLLTQSPHIGNSVGGSYLELANTLHSAALASLKGDIVELNKRLQQTERERDLLEKKLAKAQCEQSHLMREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDKHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKECADAASPALSLAELRTTCSENELAAEFTNAIRREKKLKARVQELVSALERLTKSSEIRHQQSAEFVNDLKRANSNLVAAYEKAKKKHQNKLKKLESQMMAMVERHETQVRMLKQRIALLEEENSRPHTNETSL

SEQ ID NO: 53572 - protein, 766 aa, Homo sapiens
  Payload ID: 10637
  Gene Symbol: MCC
  Gene Name: mutated in colorectal cancers
  ENSP ID: ENSP00000421615
MREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDKHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKECADAASPALSLAELRTTCSENELAAEFTNAIRREKKLKARVQELVSALERLTKSSEIRHQQSAEFVNDLKRANSNLVAAYEKAKKKHQNKLKKLESQMMAMVERHETQVRMLKQRIALLEEENSRPHTNETSL

SEQ ID NO: 53573 - protein, 715 aa, Homo sapiens
  Payload ID: 10637
  Gene Symbol: MCC
  Gene Name: mutated in colorectal cancers
  ENSP ID: ENSP00000485220
MNSGVAMKYGNDSSAELSELHSAALASLKGDIVELNKRLQQTERERDLLEKKLAKAQCEQSHLMREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDKHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKVGPEWLGDTLRLSDCPVTAQ

SEQ ID NO: 53574 - protein, 169 aa, Homo sapiens
  Payload ID: 10637
  Gene Symbol: MCC
  Gene Name: mutated in colorectal cancers
  ENSP ID: ENSP00000485492
  MOD_RES (1)..(1): Any amino acid
XVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKVI

SEQ ID NO: 53575 - protein, 756 aa, Homo sapiens
  Payload ID: 10638
  Gene Symbol: MLH1
  Gene Name: mutL homolog 1
  Uniprot ID: P40692
  ENSP ID: ENSP00000231790
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 53576 - protein, 38 aa, Homo sapiens
  Payload ID: 10638
  Gene Symbol: MLH1
  Gene Name: mutL homolog 1
  ENSP ID: ENSP00000387511
MSFVAGVIRRLDETVVNRIAAGEVIQRPANAIKEMIEN

SEQ ID NO: 53577 - protein, 38 aa, Homo sapiens; identical to SEQ ID NO: 53576
  Payload ID: 10638
  Gene Symbol: MLH1
  Gene Name: mutL homolog 1
  ENSP ID: ENSP00000392649

SEQ ID NO: 53578 - protein, 61 aa, Homo sapiens
  Payload ID: 10638
  Gene Symbol: MLH1
  Gene Name: mutL homolog 1
  ENSP ID: ENSP00000393006
EKRGPTSSNPRKRHREDSDVEMVEDDSRKEMTAACTPRRRIINLTSVLSLQEEINEQGHEE

SEQ ID NO: 53579 - protein, 515 aa, Homo sapiens
  Payload ID: 10638
  Gene Symbol: MLH1
  Gene Name: mutL homolog 1
  Uniprot ID: P40692
  ENSP ID: ENSP00000398272
MNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 53580 - protein, 105 aa, Homo sapiens
  Payload ID: 10638
  Gene Symbol: MLH1
  Gene Name: mutL homolog 1
  ENSP ID: ENSP00000398392
MNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQ

SEQ ID NO: 53581 - protein, 58 aa, Homo sapiens
  Payload ID: 10638
  Gene Symbol: MLH1
  Gene Name: mutL homolog 1
  ENSP ID: ENSP00000399329
  MOD_RES (1)..(1): Any amino acid
XPNASTVDNIRSIFGNAVSRELIEIGCEDKTLAFKMNGYISNANYSVKKCIFLLFINL

SEQ ID NO: 53582 - protein, 52 aa, Homo sapiens
  Payload ID: 10638
  Gene Symbol: MLH1
  Gene Name: mutL homolog 1
  ENSP ID: ENSP00000400844
  MOD_RES (1)..(1): Any amino acid
XELIEIGCEDKTLAFKMNGYISNANYSVKKCIFLLFINHFATRTCWPLWGDG

SEQ ID NO: 53583 - protein, 658 aa, Homo sapiens
  Payload ID: 10638
  Gene Symbol: MLH1
  Gene Name: mutL homolog 1
  Uniprot ID: P40692
  ENSP ID: ENSP00000402564
MAFEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 53584 - protein, 515 aa, Homo sapiens; identical to SEQ ID NO: 53579
  Payload ID: 10638
  Gene Symbol: MLH1
  Gene Name: mutL homolog 1
  Uniprot ID: P40692
  ENSP ID: ENSP00000402667

SEQ ID NO: 53585 - protein, 83 aa, Homo sapiens
  Payload ID: 10638
  Gene Symbol: MLH1
  Gene Name: mutL homolog 1
  ENSP ID: ENSP00000407019
MAFEALASISHVAHVTITTKTADGKCAYRASYSDGKLKAPPKPCAGNQGTQITVEDLFYNIATRRKALKNPSEEYGKILEVVG

SEQ ID NO: 53586 - protein, 38 aa, Homo sapiens; identical to SEQ ID NO: 53576
  Payload ID: 10638
  Gene Symbol: MLH1
  Gene Name: mutL homolog 1
  ENSP ID: ENSP00000407773

SEQ ID NO: 53587 - protein, 95 aa, Homo sapiens
  Payload ID: 10638
  Gene Symbol: MLH1
  Gene Name: mutL homolog 1
  ENSP ID: ENSP00000411066
  MOD_RES (1)..(1): Any amino acid
XGNAVSRELIEIGCEDKTLAFKMNGYISNANYSVKKCIFLLFINHRLVESTSLRKAIETVYAAYLPKNTHPFLYLRLCYQDLLAPLGRWLNPQQV

SEQ ID NO: 53588 - protein, 114 aa, Homo sapiens
  Payload ID: 10638
  Gene Symbol: MLH1
  Gene Name: mutL homolog 1
  ENSP ID: ENSP00000416476
EKRGPTSSNPRKRHREDSDVEMVEDDSRKEMTAACTPRRRIINLTSVLSLQEEINEQGHEVLREMLHNHSFVGCVNPQWALAQHQTKLYLLNTTKLRVKCLAPFQTPGSGLWNT

SEQ ID NO: 53589 - protein, 679 aa, Homo sapiens
  Payload ID: 10638
  Gene Symbol: MLH1
  Gene Name: mutL homolog 1
  ENSP ID: ENSP00000416687
  MOD_RES (1)..(1): Any amino acid
XRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDESEVPGSIPNSWKWTVEHIVYKALRSHILPPKHFTEDGNILQLANLPDLYKVFERC

SEQ ID NO: 53590 - protein, 48 aa, Homo sapiens
  Payload ID: 10638
  Gene Symbol: MLH1
  Gene Name: mutL homolog 1
  ENSP ID: ENSP00000416783
MSFVAGVIRRLDETVVNRIAAGEVIQRPANAIKEMIENWYGGSRAGLT

SEQ ID NO: 53591 - protein, 515 aa, Homo sapiens; identical to SEQ ID NO: 53579
  Payload ID: 10638
  Gene Symbol: MLH1
  Gene Name: mutL homolog 1
  Uniprot ID: P40692
  ENSP ID: ENSP00000443665

SEQ ID NO: 53592 - protein, 515 aa, Homo sapiens; identical to SEQ ID NO: 53579
  Payload ID: 10638
  Gene Symbol: MLH1
  Gene Name: mutL homolog 1
  Uniprot ID: P40692
  ENSP ID: ENSP00000444286

SEQ ID NO: 53593 - protein, 223 aa, Homo sapiens
  Payload ID: 10638
  Gene Symbol: MLH1
  Gene Name: mutL homolog 1
  ENSP ID: ENSP00000480669
  MOD_RES (1)..(1): Any amino acid
XVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEV

SEQ ID NO: 53594 - protein, 1453 aa, Homo sapiens
  Payload ID: 10639
  Gene Symbol: MLH3
  Gene Name: mutL homolog 3
  Uniprot ID: Q9UHC1
  ENSP ID: ENSP00000348020
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILNSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEAGGNLLVLVDQHAAHERIRLEQLIIDSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 53595 - protein, 1429 aa, Homo sapiens
  Payload ID: 10639
  Gene Symbol: MLH3
  Gene Name: mutL homolog 3
  Uniprot ID: Q9UHC1
  ENSP ID: ENSP00000370355
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILNSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEADSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 53596 - protein, 199 aa, Homo sapiens
  Payload ID: 10639
  Gene Symbol: MLH3
  Gene Name: mutL homolog 3
  ENSP ID: ENSP00000450647
  MOD_RES (1)..(1): Any amino acid
XMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVLQQVDNKFIACLMSTKTEENGEAAELMMLQDPCCRQSREDENHEFSL

SEQ ID NO: 53597 - protein, 124 aa, Homo sapiens
  Payload ID: 10639
  Gene Symbol: MLH3
  Gene Name: mutL homolog 3
  ENSP ID: ENSP00000451055
EFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 53598 - protein, 106 aa, Homo sapiens
  Payload ID: 10639
  Gene Symbol: MLH3
  Gene Name: mutL homolog 3
  ENSP ID: ENSP00000451095
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASA

SEQ ID NO: 53599 - protein, 477 aa, Homo sapiens
  Payload ID: 10639
  Gene Symbol: MLH3
  Gene Name: mutL homolog 3
  ENSP ID: ENSP00000451130
  MOD_RES (1)..(1): Any amino acid
XNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENDTVDDTVSSESLQSLFSEWDNPVFARYPEVAVDVSSGQAESLAVKIHNILYPYRFTKGMIHSMQVLQQVDNKFIACLMSTKTEENGEAGGNLLVLVDQHAAHERIRLEQLIIDSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 53600 - protein, 162 aa, Homo sapiens
  Payload ID: 10639
  Gene Symbol: MLH3
  Gene Name: mutL homolog 3
  ENSP ID: ENSP00000451192
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCM

SEQ ID NO: 53601 - protein, 1275 aa, Homo sapiens
  Payload ID: 10639
  Gene Symbol: MLH3
  Gene Name: mutL homolog 3
  ENSP ID: ENSP00000451540
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILNSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGYLFRCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 53602 - protein, 107 aa, Homo sapiens
  Payload ID: 10639
  Gene Symbol: MLH3
  Gene Name: mutL homolog 3
  ENSP ID: ENSP00000452136
  MOD_RES (1)..(1): Any amino acid
XEDIQAACTKDLTTVAVDVVLENDTVDDTVSSESLQSLFSEWDNPVFARYPEVAVDVSSGQAESLAVKIHNILYPYRFTKGMIHSMQIPTRSNRHKALVGKNYCLLL

SEQ ID NO: 53603 - protein, 1453 aa, Homo sapiens; identical to SEQ ID NO: 53594
  Payload ID: 10639
  Gene Symbol: MLH3
  Gene Name: mutL homolog 3
  Uniprot ID: Q9UHC1
  ENSP ID: ENSP00000452316

SEQ ID NO: 53604 - protein, 934 aa, Homo sapiens [sequence omitted]

SEQ ID NO: 53605 - protein, 921 aa, Homo sapiens
  Payload ID: 10640
  Gene Symbol: MSH2
  Gene Name: mutS homolog 2
  ENSP ID: ENSP00000384199
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATHFHELTALANQIPTVNNLHVTALTTEETLTMLYQVKKGVCDQSFGIHVAELANFPKHVIECAKQKALELEEFQYIGESQGYDIMEPAAKKCYLERENLRVTEPKDQCLILLTWKRKLRGGKRSACSRPERQNQGSGELS

SEQ ID NO: 53606 - protein, 140 aa, Homo sapiens
  Payload ID: 10640
  Gene Symbol: MSH2
  Gene Name: mutS homolog 2
  ENSP ID: ENSP00000411482
MGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGET

SEQ ID NO: 53607 - protein, 868 aa, Homo sapiens
  Payload ID: 10640
  Gene Symbol: MSH2
  Gene Name: mutS homolog 2
  Uniprot ID: P43246
  ENSP ID: ENSP00000442697
MGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATHFHELTALANQIPTVNNLHVTALTTEETLTMLYQVKKGVCDQSFGIHVAELANFPKHVIECAKQKALELEEFQYIGESQGYDIMEPAAKKCYLEREQGEKIIQEFLSKVKQMPFTEMSEENITIKLKQLKAEVIAKNNSFVNEIISRIKVTT

SEQ ID NO: 53608 - protein, 341 aa, Homo sapiens [sequence omitted]

SEQ ID NO: 53609 - protein, 810 aa, Homo sapiens
  Payload ID: 10640
  Gene Symbol: MSH2
  Gene Name: mutS homolog 2
  ENSP ID: ENSP00000481416
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATIFMNLLPWPIRYQLLIIYMSQHSPLKRP

SEQ ID NO: 53610 - protein, 410 aa, Homo sapiens
  Payload ID: 10640
  Gene Symbol: MSH2
  Gene Name: mutS homolog 2
  ENSP ID: ENSP00000482468
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDYFVDSQILTDLPRSFKDKQQTYKIVTDSIRV

SEQ ID NO: 53611 - protein, 533 aa, Homo sapiens
  Payload ID: 10640
  Gene Symbol: MSH2
  Gene Name: mutS homolog 2
  ENSP ID: ENSP00000483159
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEKSPS

SEQ ID NO: 53612 - protein, 485 aa, Homo sapiens
  Payload ID: 10640
  Gene Symbol: MSH2
  Gene Name: mutS homolog 2
  ENSP ID: ENSP00000484137
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELRNNE

SEQ ID NO: 53613 - protein, 1137 aa, Homo sapiens
  Payload ID: 10641
  Gene Symbol: MSH3
  Gene Name: mutS homolog 3
  Uniprot ID: P20585
  ENSP ID: ENSP00000265081
MSRRKPASGGLAASSSAPARQAVLSRFFQSTGSLKSTSSSTGAADQVDPGAAAAAAAAAAAAPPAPPAPAFPPQLPPHIATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGQSTFMEELTDTAEIIRKATSQSLVILDELGRGTSTHDGIAIAYATLEYFIRDVKSLTLFVTHYPPVCELEKNYSHQVGNYHMGFLVSEDESKLDPGAAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 53614 - protein, 936 aa, Homo sapiens
  Payload ID: 10642
  Gene Symbol: MSH4
  Gene Name: mutS homolog 4
  Uniprot ID: O15457
  ENSP ID: ENSP00000263187
MLRPEISSTSPSAPAVSPSSGETRSPQGPRYNFGLQETPQSRPSVQVVSASTCPGTSGAAGDRSSSSSSLPCPAPNSRPAQGSYFGNKRAYAENTVASNFTFGASSSSARDTNYPQTLKTPLSTGNPQRSGYKSWTPQVGYSASSSSAISAHSPSVIVAVVEGRGLARGEIGMASIDLKNPQIILSQFADNTTYAKVITKLKILSPLEIIMSNTACAVGNSTKLFTLITENFKNVNFTTIQRKYFNETKGLEYIEQLCIAEFSTVLMEVQSKYYCLAAVAALLKYVEFIQNSVYAPKSLKICFQGSEQTAMIDSSSAQNLELLINNQDYRNNHTLFGVLNYTKTPGGSRRLRSNILEPLVDIETINMRLDCVQELLQDEELFFGLQSVISRFLDTEQLLSVLVQIPKQDTVNAAESKITNLIYLKHTLELVDPLKIAMKNCNTPLLRAYYGSLEDKRFGIILEKIKTVINDDARYMKGCLNMRTQKCYAVRSNINEFLDIARRTYTEIVDDIAGMISQLGEKYSLPLRTSFSSARGFFIQMTTDCIALPSDQLPSEFIKISKVKNSYSFTSADLIKMNERCQESLREIYHMTYMIVCKLLSEIYEHIHCLYKLSDTVSMLDMLLSFAHACTLSDYVRPEFTDTLAIKQGWHPILEKISAEKPIANNTYVTEGSNFLIITGPNMSGKSTYLKQIALCQIMAQIGSYVPAEYSSFRIAKQIFTRISTDDDIETNSSTFMKEMKEIAYILHNANDKSLILIDELGRGTNTEEGIGICYAVCEYLLSLKAFTLFATHFLELCHIDALYPNVENMHFEVQHVKNTSRNKEAILYTYKLSKGLTEEKNYGLKAAEVSSLPPSIVLDAKEITTQITRQILQNQRSTPEMERQRAVYHLATRLVQTARNSQLDPDSLRIYLSNLKKKYKEDFPRTEQVPEKTEE

SEQ ID NO: 53615 - protein, 835 aa, Homo sapiens
  Payload ID: 10643
  Gene Symbol: MSH5
  Gene Name: mutS homolog 5
  Uniprot ID: O43196
  ENSP ID: ENSP00000364855
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 53616 - protein, 822 aa, Homo sapiens
  Payload ID: 10643
  Gene Symbol: MSH5
  Gene Name: mutS homolog 5
  Uniprot ID: O43196
  ENSP ID: ENSP00000364892
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSQVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYLTMETCEDGNDLVFFYQVSDLIRSGKPIKPVKDLLKKNQMENCQTLVDKFMKLDLEDPNLDLNVFMSQEVLPAATSIL

SEQ ID NO: 53617 - protein, 834 aa, Homo sapiens
  Payload ID: 10643
  Gene Symbol: MSH5
  Gene Name: mutS homolog 5
  Uniprot ID: O43196
  ENSP ID: ENSP00000364903
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 53618 - protein, 834 aa, Homo sapiens; identical to SEQ ID NO: 53617
  Payload ID: 10643
  Gene Symbol: MSH5
  Gene Name: mutS homolog 5
  Uniprot ID: O43196
  ENSP ID: ENSP00000364908

SEQ ID NO: 53619 - protein, 508 aa, Homo sapiens
  Payload ID: 10643
  Gene Symbol: MSH5
  Gene Name: mutS homolog 5
  ENSP ID: ENSP00000379194
MWPVLLFVFLSQTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 53620 - protein, 497 aa, Homo sapiens
  Payload ID: 10643
  Gene Symbol: MSH5
  Gene Name: mutS homolog 5
  ENSP ID: ENSP00000387397
TVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 53621 - protein, 156 aa, Homo sapiens
  Payload ID: 10643
  Gene Symbol: MSH5
  Gene Name: mutS homolog 5
  ENSP ID: ENSP00000387458
TAQSLVLIDEFGKGTNTVDGLALLAAVLRHWLARGPTCPHIFVATNFLSLVQLQLLPQGPLVQYLVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 53622 - protein, 822 aa, Homo sapiens; identical to SEQ ID NO: 53616
  Payload ID: 10643
  Gene Symbol: MSH5
  Gene Name: mutS homolog 5
  Uniprot ID: O43196
  ENSP ID: ENSP00000387609

SEQ ID NO: 53623 - protein, 194 aa, Homo sapiens
  Payload ID: 10643
  Gene Symbol: MSH5
  Gene Name: mutS homolog 5
  ENSP ID: ENSP00000387921
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRR

SEQ ID NO: 53624 - protein, 834 aa, Homo sapiens; identical to SEQ ID NO: 53617
  Payload ID: 10643
  Gene Symbol: MSH5
  Gene Name: mutS homolog 5
  Uniprot ID: O43196
  ENSP ID: ENSP00000388037

SEQ ID NO: 53625 - protein, 467 aa, Homo sapiens
  Payload ID: 10643
  Gene Symbol: MSH5
  Gene Name: mutS homolog 5
  ENSP ID: ENSP00000389840
TVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYLTMETCEDGNDLVFFYQVSDLIRSGKPIKPVKDLLKKNQMENCQTLVDKFMKLDLEDPNLDLNVFMSQEVLPAATSIL

SEQ ID NO: 53626 - protein, 115 aa, Homo sapiens
  Payload ID: 10643
  Gene Symbol: MSH5
  Gene Name: mutS homolog 5
  ENSP ID: ENSP00000391330
IAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMVRPSTSVR

SEQ ID NO: 53627 - protein, 508 aa, Homo sapiens; identical to SEQ ID NO: 53619
  Payload ID: 10643
  Gene Symbol: MSH5
  Gene Name: mutS homolog 5
  ENSP ID: ENSP00000391394

SEQ ID NO: 53628 - protein, 194 aa, Homo sapiens; identical to SEQ ID NO: 53623
  Payload ID: 10643
  Gene Symbol: MSH5
  Gene Name: mutS homolog 5
  ENSP ID: ENSP00000391401

SEQ ID NO: 53629 - protein, 135 aa, Homo sapiens
  Payload ID: 10643
  Gene Symbol: MSH5
  Gene Name: mutS homolog 5
  ENSP ID: ENSP00000393445
GYSRPRYSPQVLGVRIQNGRHPLMELCARTFVPNSTECGGDKGRVKVITGPNSSGKSIYLKQVAKAVNNATAQSLVLIDEFGKGTNTVDGLALLAAVLRHWLARGPTCPHIFVATNFLSLVQLQLLPQGPLVQYL

SEQ ID NO: 53630 - protein, 834 aa, Homo sapiens; identical to SEQ ID NO: 53617
  Payload ID: 10643
  Gene Symbol: MSH5
  Gene Name: mutS homolog 5
  Uniprot ID: O43196
  ENSP ID: ENSP00000394017

SEQ ID NO: 53631 - protein, 90 aa, Homo sapiens
  Payload ID: 10643
  Gene Symbol: MSH5
  Gene Name: mutS homolog 5
  ENSP ID: ENSP00000394254
MASLGANPRRTPQGPRPGAASSGFPSPAPVPGPREAEEEEVEEEEELAEIHLCVLWNSGYLGIAYYDTSDSTIHFMPDAPDHESLKLLQR

SEQ ID NO: 53632 - protein, 745 aa, Homo sapiens
  Payload ID: 10643
  Gene Symbol: MSH5
  Gene Name: mutS homolog 5
  ENSP ID: ENSP00000394619
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSQVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYL

SEQ ID NO: 53633 - protein, 835 aa, Homo sapiens; identical to SEQ ID NO: 53615
  Payload ID: 10643
  Gene Symbol: MSH5
  Gene Name: mutS homolog 5
  Uniprot ID: O43196
  ENSP ID: ENSP00000394649

SEQ ID NO: 53634 - protein, 333 aa, Homo sapiens
  Payload ID: 10643
  Gene Symbol: MSH5
  Gene Name: mutS homolog 5
  ENSP ID: ENSP00000394971
KILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVYLSPQVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLG

SEQ ID NO: 53635 - protein, 821 aa, Homo sapiens
  Payload ID: 10643
  Gene Symbol: MSH5
  Gene Name: mutS homolog 5
  ENSP ID: ENSP00000395133
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSQVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVSDLIRSGKPIKPVKDLLKKNQMENCQTLVDKFMKLDLEDPNLDLNVFMSQEVLPAATSIL

SEQ ID NO: 53636 - protein, 270 aa, Homo sapiens
  Payload ID: 10643
  Gene Symbol: MSH5
  Gene Name: mutS homolog 5
  Uniprot ID: O43196
  ENSP ID: ENSP00000396509
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLL

SEQ ID NO: 53637 - protein, 333 aa, Homo sapiens; identical to SEQ ID NO: 53634
  Payload ID: 10643
  Gene Symbol: MSH5
  Gene Name: mutS homolog 5
  ENSP ID: ENSP00000396934

SEQ ID NO: 53638 - protein, 158 aa, Homo sapiens
  Payload ID: 10643
  Gene Symbol: MSH5
  Gene Name: mutS homolog 5
  ENSP ID: ENSP00000397187
TVYSALGLRDACRSLPQSIQLFRDIAQEFSDDLHHIASLIGKVYLSPQVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLG

SEQ ID NO: 53639 - protein, 107 aa, Homo sapiens
  Payload ID: 10643
  Gene Symbol: MSH5
  Gene Name: mutS homolog 5
  ENSP ID: ENSP00000397355
KILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLL

SEQ ID NO: 53640 - protein, 508 aa, Homo sapiens; identical to SEQ ID NO: 53619
  Payload ID: 10643
  Gene Symbol: MSH5
  Gene Name: mutS homolog 5
  ENSP ID: ENSP00000398373

SEQ ID NO: 53641 - protein, 508 aa, Homo sapiens; identical to SEQ ID NO: 53619
  Payload ID: 10643
  Gene Symbol: MSH5
  Gene Name: mutS homolog 5
  ENSP ID: ENSP00000398538

SEQ ID NO: 53642 - protein, 90 aa, Homo sapiens; identical to SEQ ID NO: 53631
  Payload ID: 10643
  Gene Symbol: MSH5
  Gene Name: mutS homolog 5
  ENSP ID: ENSP00000399303

SEQ ID NO: 53643 - protein, 194 aa, Homo sapiens; identical to SEQ ID NO: 53623
  Payload ID: 10643
  Gene Symbol: MSH5
  Gene Name: mutS homolog 5
  ENSP ID: ENSP00000399470

SEQ ID NO: 53644 - protein, 834 aa, Homo sapiens; identical to SEQ ID NO: 53617
  Payload ID: 10643
  Gene Symbol: MSH5
  Gene Name: mutS homolog 5
  Uniprot ID: O43196
  ENSP ID: ENSP00000399721

SEQ ID NO: 53645 - protein, 158 aa, Homo sapiens
  Payload ID: 10643
  Gene Symbol: MSH5
  Gene Name: mutS homolog 5
  ENSP ID: ENSP00000399898
HESLKLLQRVLDEINPQSVVTSAKQDENMTRFLGKLASQEHREPKRPEIIFLPSVDFGLEISKQRLLSGNYSFIPDAMTATEKILFLSSIIPFDCLLTIPSQVRALGGLLKFLGRRRIGVELEDYNVSVPILGFKKFMLTHLVNIDQDTYRNPQQMPL

SEQ ID NO: 53646 - protein, 270 aa, Homo sapiens; identical to SEQ ID NO: 53636
  Payload ID: 10643
  Gene Symbol: MSH5
  Gene Name: mutS homolog 5
  Uniprot ID: O43196
  ENSP ID: ENSP00000400187

SEQ ID NO: 53647 - protein, 508 aa, Homo sapiens; identical to SEQ ID NO: 53619
  Payload ID: 10643
  Gene Symbol: MSH5
  Gene Name: mutS homolog 5
  ENSP ID: ENSP00000400820

SEQ ID NO: 53648 - protein, 727 aa, Homo sapiens
  Payload ID: 10643
  Gene Symbol: MSH5
  Gene Name: mutS homolog 5
  ENSP ID: ENSP00000401072
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYL

SEQ ID NO: 53649 - protein, 156 aa, Homo sapiens; identical to SEQ ID NO: 53621
  Payload ID: 10643
  Gene Symbol: MSH5
  Gene Name: mutS homolog 5
  ENSP ID: ENSP00000401120

SEQ ID NO: 53650 - protein, 496 aa, Homo sapiens; identical to SEQ ID NO: 53055
  Payload ID: 10643
  Gene Symbol: MSH5
  Gene Name: mutS homolog 5
  ENSP ID: ENSP00000402188

SEQ ID NO: 53651 - protein, 834 aa, Homo sapiens; identical to SEQ ID NO: 53617
  Payload ID: 10643
  Gene Symbol: MSH5
  Gene Name: mutS homolog 5
  Uniprot ID: O43196
  ENSP ID: ENSP00000402659

SEQ ID NO: 53652 - protein, 194 aa, Homo sapiens; identical to SEQ ID NO: 53623
  Payload ID: 10643
  Gene Symbol: MSH5
  Gene Name: mutS homolog 5
  ENSP ID: ENSP00000402842

SEQ ID NO: 53653 - protein, 194 aa, Homo sapiens; identical to SEQ ID NO: 53623
  Payload ID: 10643
  Gene Symbol: MSH5
  Gene Name: mutS homolog 5
  ENSP ID: ENSP00000403240

SEQ ID NO: 53654 - protein, 508 aa, Homo sapiens; identical to SEQ ID NO: 53619
  Payload ID: 10643
  Gene Symbol: MSH5
  Gene Name: mutS homolog 5
  ENSP ID: ENSP00000403531

SEQ ID NO: 53655 - protein, 90 aa, Homo sapiens; identical to SEQ ID NO: 53631
  Payload ID: 10643
  Gene Symbol: MSH5
  Gene Name: mutS homolog 5
  ENSP ID: ENSP00000403777

SEQ ID NO: 53656 - protein, 466 aa, Homo sapiens
  Payload ID: 10643
  Gene Symbol: MSH5
  Gene Name: mutS homolog 5
  ENSP ID: ENSP00000403809
TVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVSDLIRSGKPIKPVKDLLKKNQMENCQTLVDKFMKLDLEDPNLDLNVFMSQEVLPAATSIL

SEQ ID NO: 53657 - protein, 333 aa, Homo sapiens; identical to SEQ ID NO: 53634
  Payload ID: 10643
  Gene Symbol: MSH5
  Gene Name: mutS homolog 5
  ENSP ID: ENSP00000404249

SEQ ID NO: 53658 - protein, 270 aa, Homo sapiens; identical to SEQ ID NO: 53636
  Payload ID: 10643
  Gene Symbol: MSH5
  Gene Name: mutS homolog 5
  Uniprot ID: O43196
  ENSP ID: ENSP00000404892

SEQ ID NO: 53659 - protein, 728 aa, Homo sapiens
  Payload ID: 10643
  Gene Symbol: MSH5
  Gene Name: mutS homolog 5
  ENSP ID: ENSP00000405073
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQQVAKAVNNATAQSLVLIDEFGKGTNTVDGLALLAAVLRHWLARGPTCPHIFVATNFLSLVQLQLLPQGPLVQYL

SEQ ID NO: 53660 - protein, 496 aa, Homo sapiens; identical to SEQ ID NO: 53055
  Payload ID: 10643
  Gene Symbol: MSH5
  Gene Name: mutS homolog 5
  ENSP ID: ENSP00000405530

SEQ ID NO: 53661 - protein, 156 aa, Homo sapiens; identical to SEQ ID NO: 53621
  Payload ID: 10643
  Gene Symbol: MSH5
  Gene Name: mutS homolog 5
  ENSP ID: ENSP00000406211

SEQ ID NO: 53662 - protein, 834 aa, Homo sapiens; identical to SEQ ID NO: 53617
  Payload ID: 10643
  Gene Symbol: MSH5
  Gene Name: mutS homolog 5
  Uniprot ID: O43196
  ENSP ID: ENSP00000406269

SEQ ID NO: 53663 - protein, 156 aa, Homo sapiens; identical to SEQ ID NO: 53621
  Payload ID: 10643
  Gene Symbol: MSH5
  Gene Name: mutS homolog 5
  ENSP ID: ENSP00000406310

SEQ ID NO: 53664 - protein, 637 aa, Homo sapiens
  Payload ID: 10643
  Gene Symbol: MSH5
  Gene Name: mutS homolog 5
  ENSP ID: ENSP00000406352
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQLRIHLPWPLHLHDRPQPGGESSEQCHCTVAGPY

SEQ ID NO: 53665 - protein, 156 aa, Homo sapiens; identical to SEQ ID NO: 53621
  Payload ID: 10643
  Gene Symbol: MSH5
  Gene Name: mutS homolog 5
  ENSP ID: ENSP00000406849

SEQ ID NO: 53666 - protein, 835 aa, Homo sapiens; identical to SEQ ID NO: 53615
  Payload ID: 10643
  Gene Symbol: MSH5
  Gene Name: mutS homolog 5
  Uniprot ID: O43196
  ENSP ID: ENSP00000406868

SEQ ID NO: 53667 - protein, 835 aa, Homo sapiens; identical to SEQ ID NO: 53615
  Payload ID: 10643
  Gene Symbol: MSH5
  Gene Name: mutS homolog 5
  Uniprot ID: O43196
  ENSP ID: ENSP00000407047

SEQ ID NO: 53668 - protein, 333 aa, Homo sapiens; identical to SEQ ID NO: 53634
  Payload ID: 10643
  Gene Symbol: MSH5
  Gene Name: mutS homolog 5
  ENSP ID: ENSP00000407288

SEQ ID NO: 53669 - protein, 496 aa, Homo sapiens; identical to SEQ ID NO: 53055
  Payload ID: 10643
  Gene Symbol: MSH5
  Gene Name: mutS homolog 5
  ENSP ID: ENSP00000408136

SEQ ID NO: 53670 - protein, 834 aa, Homo sapiens; identical to SEQ ID NO: 53617
  Payload ID: 10643
  Gene Symbol: MSH5
  Gene Name: mutS homolog 5
  Uniprot ID: O43196
  ENSP ID: ENSP00000409181

SEQ ID NO: 53671 - protein, 401 aa, Homo sapiens
  Payload ID: 10643
  Gene Symbol: MSH5
  Gene Name: mutS homolog 5
  ENSP ID: ENSP00000409468
MWPVLLFVFLSQTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYL

SEQ ID NO: 53672 - protein, 497 aa, Homo sapiens; identical to SEQ ID NO: 53620
  Payload ID: 10643
  Gene Symbol: MSH5
  Gene Name: mutS homolog 5
  ENSP ID: ENSP00000409866

SEQ ID NO: 53673 - protein, 194 aa, Homo sapiens; identical to SEQ ID NO: 53623
  Payload ID: 10643
  Gene Symbol: MSH5
  Gene Name: mutS homolog 5
  ENSP ID: ENSP00000410698

SEQ ID NO: 53674 - protein, 333 aa, Homo sapiens; identical to SEQ ID NO: 53634
  Payload ID: 10643
  Gene Symbol: MSH5
  Gene Name: mutS homolog 5
  ENSP ID: ENSP00000411551

SEQ ID NO: 53675 - protein, 158 aa, Homo sapiens; identical to SEQ ID NO: 53638
  Payload ID: 10643
  Gene Symbol: MSH5
  Gene Name: mutS homolog 5
  ENSP ID: ENSP00000411570

SEQ ID NO: 53676 - protein, 496 aa, Homo sapiens; identical to SEQ ID NO: 53055
  Payload ID: 10643
  Gene Symbol: MSH5
  Gene Name: mutS homolog 5
  ENSP ID: ENSP00000412179

SEQ ID NO: 53677 - protein, 156 aa, Homo sapiens; identical to SEQ ID NO: 53621
  Payload ID: 10643
  Gene Symbol: MSH5
  Gene Name: mutS homolog 5
  ENSP ID: ENSP00000413269

SEQ ID NO: 53678 - protein, 727 aa, Homo sapiens; identical to SEQ ID NO: 53648
  Payload ID: 10643
  Gene Symbol: MSH5
  Gene Name: mutS homolog 5
  ENSP ID: ENSP00000413831

SEQ ID NO: 53679 - protein, 821 aa, Homo sapiens; identical to SEQ ID NO: 53635
  Payload ID: 10643
  Gene Symbol: MSH5
  Gene Name: mutS homolog 5
  ENSP ID: ENSP00000414937

SEQ ID NO: 53680 - protein, 194 aa, Homo sapiens; identical to SEQ ID NO: 53623
  Payload ID: 10643
  Gene Symbol: MSH5
  Gene Name: mutS homolog 5
  ENSP ID: ENSP00000415135

SEQ ID NO: 53681 - protein, 65 aa, Homo sapiens
  Payload ID: 10643
  Gene Symbol: MSH5
  Gene Name: mutS homolog 5
  ENSP ID: ENSP00000415294
TAQSLVLIDEFGKGTNTVDGLALLAAVLRHWLARGPTCPHIFVATNFLSLVQLQLLPQGPLVQYL

SEQ ID NO: 53682 - protein, 287 aa, Homo sapiens
  Payload ID: 10643
  Gene Symbol: MSH5
  Gene Name: mutS homolog 5
  ENSP ID: ENSP00000415811
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSQVRALGGLLKFLGRRRIGVELEDYNVSVPILGFKKFMLTHLVNIDQDTYSVLQIFKSESHPSVYKVASGLKEGLSLFGILNRCHCKWGEKLL

SEQ ID NO: 53683 - protein, 43 aa, Homo sapiens
  Payload ID: 10643
  Gene Symbol: MSH5
  Gene Name: mutS homolog 5
  ENSP ID: ENSP00000419131
  MOD_RES (1)..(1): Any amino acid
XRIGVELEDYNVSVPILGFKKFMLTHLVNIDQDTYRNPQQMPL

SEQ ID NO: 53684 - protein, 159 aa, Homo sapiens
  Payload ID: 10643
  Gene Symbol: MSH5
  Gene Name: mutS homolog 5
  ENSP ID: ENSP00000419648
  MOD_RES (1)..(1): Any amino acid
XDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYRNPQQMPL

SEQ ID NO: 53685 - protein, 166 aa, Homo sapiens
  Payload ID: 10643
  Gene Symbol: MSH5
  Gene Name: mutS homolog 5
  ENSP ID: ENSP00000420232
GYSRPRYSPQVLGVRIQNGRHPLMELCARTFVPNSTECGGDKGRVKVITGPNSSGKSIYLKQVAKAVNNATAQSLVLIDEFGKGTNTVDGLALLAAVLRHWLARGPTCPHIFVATNFLSLVQLQLLPQGPLVQYLDWPRVSGQEGGLRRCCEGQPCLPHSCPGWAS

SEQ ID NO: 53686 - protein, 166 aa, Homo sapiens; identical to SEQ ID NO: 53685
  Payload ID: 10643
  Gene Symbol: MSH5
  Gene Name: mutS homolog 5
  ENSP ID: ENSP00000431340

SEQ ID NO: 53687 - protein, 47 aa, Homo sapiens
  Payload ID: 10643
  Gene Symbol: MSH5
  Gene Name: mutS homolog 5
  ENSP ID: ENSP00000431393
TVYSALGLRDACRSLPQSIQLFRDIAQEFSDDLHHIASLIGKVKSED

SEQ ID NO: 53688 - protein, 166 aa, Homo sapiens; identical to SEQ ID NO: 53685
  Payload ID: 10643
  Gene Symbol: MSH5
  Gene Name: mutS homolog 5
  ENSP ID: ENSP00000431494

SEQ ID NO: 53689 - protein, 49 aa, Homo sapiens
  Payload ID: 10643
  Gene Symbol: MSH5
  Gene Name: mutS homolog 5
  ENSP ID: ENSP00000433922
MPLHSRWSLLMNLEREPTRWMGSRFWPLCSDTGWHVDPHAPTSLWPPTF

SEQ ID NO: 53690 - protein, 166 aa, Homo sapiens; identical to SEQ ID NO: 53685
  Payload ID: 10643
  Gene Symbol: MSH5
  Gene Name: mutS homolog 5
  ENSP ID: ENSP00000434231

SEQ ID NO: 53691 - protein, 166 aa, Homo sapiens; identical to SEQ ID NO: 53685
  Payload ID: 10643
  Gene Symbol: MSH5
  Gene Name: mutS homolog 5
  ENSP ID: ENSP00000435784

SEQ ID NO: 53692 - protein, 90 aa, Homo sapiens; identical to SEQ ID NO: 53631
  Payload ID: 10643
  Gene Symbol: MSH5
  Gene Name: mutS homolog 5
  ENSP ID: ENSP00000440697

SEQ ID NO: 53693 - protein, 90 aa, Homo sapiens; identical to SEQ ID NO: 53631
  Payload ID: 10643
  Gene Symbol: MSH5
  Gene Name: mutS homolog 5
  ENSP ID: ENSP00000443668

SEQ ID NO: 53694 - protein, 1360 aa, Homo sapiens
  Payload ID: 10644
  Gene Symbol: MSH6
  Gene Name: mutS homolog 6
  Uniprot ID: P52701
  ENSP ID: ENSP00000234420
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 53695 - protein, 101 aa, Homo sapiens
  Payload ID: 10644
  Gene Symbol: MSH6
  Gene Name: mutS homolog 6
  ENSP ID: ENSP00000390382
MEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPS

SEQ ID NO: 53696 - protein, 115 aa, Homo sapiens
  Payload ID: 10644
  Gene Symbol: MSH6
  Gene Name: mutS homolog 6
  ENSP ID: ENSP00000397484
MEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTY

SEQ ID NO: 53697 - protein, 160 aa, Homo sapiens
  Payload ID: 10644
  Gene Symbol: MSH6
  Gene Name: mutS homolog 6
  ENSP ID: ENSP00000405294
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVSKRLLKPYTGRHNLRNR

SEQ ID NO: 53698 - protein, 151 aa, Homo sapiens
  Payload ID: 10644
  Gene Symbol: MSH6
  Gene Name: mutS homolog 6
  ENSP ID: ENSP00000406248
MEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRV

SEQ ID NO: 53699 - protein, 104 aa, Homo sapiens
  Payload ID: 10644
  Gene Symbol: MSH6
  Gene Name: mutS homolog 6
  ENSP ID: ENSP00000410570
MSRQSTLYSFFPKSPALSDANKASARASREGGRAAAAPGASPSPGGDAAWSEAGPGPRPLARSASPPKAKNLNGGLRRSVAPAAPTRFKIKGSPEGRSFLQCKA

SEQ ID NO: 53700 - protein, 1058 aa, Homo sapiens
  Payload ID: 10644
  Gene Symbol: MSH6
  Gene Name: mutS homolog 6
  Uniprot ID: P52701
  ENSP ID: ENSP00000438580
MVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 53701 - protein, 1230 aa, Homo sapiens
  Payload ID: 10644
  Gene Symbol: MSH6
  Gene Name: mutS homolog 6
  Uniprot ID: P52701
  ENSP ID: ENSP00000446475
MSRQSTLYSFFPKSPALSDANKASARASREGGRAAAAPGASPSPGGDAAWSEAGPGPRPLARSASPPKAKNLNGGLRRSVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 53702 - protein, 51 aa, Homo sapiens
  Payload ID: 10644
  Gene Symbol: MSH6
  Gene Name: mutS homolog 6
  ENSP ID: ENSP00000475605
MEGYPWWPCLVYNHPFDGTFIREKGKSVRVHVQFFDDSPTRGWVSKRLLKP

SEQ ID NO: 53703 - protein, 1058 aa, Homo sapiens; identical to SEQ ID NO: 53700
  Payload ID: 10644
  Gene Symbol: MSH6
  Gene Name: mutS homolog 6
  Uniprot ID: P52701
  ENSP ID: ENSP00000477844

SEQ ID NO: 53704 - protein, 1067 aa, Homo sapiens
  Payload ID: 10644
  Gene Symbol: MSH6
  Gene Name: mutS homolog 6
  ENSP ID: ENSP00000480261
MSRQSTLYSFFPKSPALSDANKASARASREGGRARCPRGLSFPRRGCGLERGWAWARPLARSASPPKAKNLNGGLRRSVAPAAPTSCDFSPGDLVWAKMEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLGKTLNKLVLRL

SEQ ID NO: 53705 - protein, 327 aa, Homo sapiens [sequence omitted]

SEQ ID NO: 53706 - protein, 522 aa, Homo sapiens
  Payload ID: 10645
  Gene Symbol: MUTYH
  Gene Name: mutY DNA glycosylase
  Uniprot ID: Q9UIF7
  ENSP ID: ENSP00000346354
MRKPRAAVGSGHRKQAASQEGRQKHAKNNSQAKPSACDAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 53707 - protein, 521 aa, Homo sapiens
  Payload ID: 10645
  Gene Symbol: MUTYH
  Gene Name: mutY DNA glycosylase
  Uniprot ID: Q9UIF7
  ENSP ID: ENSP00000347685
MRKPRAAVGSGHRKQAASQEGRQKHAKNNSQAKPSACDGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 53708 - protein, 546 aa, Homo sapiens
  Payload ID: 10645
  Gene Symbol: MUTYH
  Gene Name: mutY DNA glycosylase
  Uniprot ID: Q9UIF7
  ENSP ID: ENSP00000361170
MTPLVSRLSRLWAIMRKPRAAVGSGHRKQAASQEGRQKHAKNNSQAKPSACDGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 53709 - protein, 521 aa, Homo sapiens; identical to SEQ ID NO: 53707
  Payload ID: 10645
  Gene Symbol: MUTYH
  Gene Name: mutY DNA glycosylase
  Uniprot ID: Q9UIF7
  ENSP ID: ENSP00000361176

SEQ ID NO: 53710 - protein, 536 aa, Homo sapiens
  Payload ID: 10645
  Gene Symbol: MUTYH
  Gene Name: mutY DNA glycosylase
  Uniprot ID: Q9UIF7
  ENSP ID: ENSP00000361182
MTPLVSRLSRLWAIMRKPRAAVGSGHRKQAASQEGRQKHAKNNSQAKPSACDAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 53711 - protein, 535 aa, Homo sapiens
  Payload ID: 10645
  Gene Symbol: MUTYH
  Gene Name: mutY DNA glycosylase
  Uniprot ID: Q9UIF7
  ENSP ID: ENSP00000361187
MTPLVSRLSRLWAIMRKPRAAVGSGHRKQAASQEGRQKHAKNNSQAKPSACDGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 53712 - protein, 291 aa, Homo sapiens
  Payload ID: 10645
  Gene Symbol: MUTYH
  Gene Name: mutY DNA glycosylase
  ENSP ID: ENSP00000403655
MRKPRAAVGSGHRKQAASQEGRQKHAKNNSQAKPSACDGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRA

SEQ ID NO: 53713 - protein, 521 aa, Homo sapiens; identical to SEQ ID NO: 53707
  Payload ID: 10645
  Gene Symbol: MUTYH
  Gene Name: mutY DNA glycosylase
  Uniprot ID: Q9UIF7
  ENSP ID: ENSP00000407590

SEQ ID NO: 53714 - protein, 549 aa, Homo sapiens
  Payload ID: 10645
  Gene Symbol: MUTYH
  Gene Name: mutY DNA glycosylase
  ENSP ID: ENSP00000408176
MTPLVSRLSRLWAIMRKPRAAVGSGHRKQAASQEGRQKHAKNNSQAKPSACDACAGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 53715 - protein, 532 aa, Homo sapiens
  Payload ID: 10645
  Gene Symbol: MUTYH
  Gene Name: mutY DNA glycosylase
  Uniprot ID: Q9UIF7
  ENSP ID: ENSP00000409718
MRKPRAAVGSGHRKQAASQEGRQKHAKNNSQAKPSACDGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 53716 - protein, 215 aa, Homo sapiens
  Payload ID: 10645
  Gene Symbol: MUTYH
  Gene Name: mutY DNA glycosylase
  ENSP ID: ENSP00000410263
MTPLVSRLSRLWEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREES

SEQ ID NO: 53717 - protein, 44 aa, Homo sapiens
  Payload ID: 10645
  Gene Symbol: MUTYH
  Gene Name: mutY DNA glycosylase
  ENSP ID: ENSP00000431264
  MOD_RES (1)..(1): Any amino acid
XTPVTTVPPGARWLTQEEFHTAAVSTAMKKVFRVYQGQQPGTCM

SEQ ID NO: 53718 - protein, 62 aa, Homo sapiens
  Payload ID: 10645
  Gene Symbol: MUTYH
  Gene Name: mutY DNA glycosylase
  ENSP ID: ENSP00000431292
MRKPRAAVGSGHRKQAASQEGRQKHAKNNSQAKPSACDGFQKVPGVLSVQSEKAPHGPASPG

SEQ ID NO: 53719 - protein, 55 aa, Homo sapiens
  Payload ID: 10645
  Gene Symbol: MUTYH
  Gene Name: mutY DNA glycosylase
  ENSP ID: ENSP00000431568
MTPLVSRLSRLWAIMRKPRAAVGSGHRKQAASQEGRQKHAKNNSQAKPSACDGRR

SEQ ID NO: 53720 - protein, 216 aa, Homo sapiens
  Payload ID: 10645
  Gene Symbol: MUTYH
  Gene Name: mutY DNA glycosylase
  ENSP ID: ENSP00000432330
MRKPRAAVGSGHRKQAASQEGRQKHAKNNSQAKPSACDGGESTLGWPGLLFSWPAAAGGSSEGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 53721 - protein, 213 aa, Homo sapiens
  Payload ID: 10645
  Gene Symbol: MUTYH
  Gene Name: mutY DNA glycosylase
  ENSP ID: ENSP00000432528
  MOD_RES (1)..(1): Any amino acid
XPGDFNQAAMELGATVCTPQRPLCSQCPVESLCRARQRVEQEQLLASGSLSGSPDVEECGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 53722 - protein, 535 aa, Homo sapiens
  Payload ID: 10645
  Gene Symbol: MUTYH
  Gene Name: mutY DNA glycosylase
  ENSP ID: ENSP00000433130
MRKPRAAVGSGHRKQAASQEGRQKHAKNNSQAKPSACDACAGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 53723 - protein, 40 aa, Homo sapiens
  Payload ID: 10645
  Gene Symbol: MUTYH
  Gene Name: mutY DNA glycosylase
  ENSP ID: ENSP00000433843
MRKPRAAVGSGHRKQAASQEGRQKHAKNNSQAKPSACDET

SEQ ID NO: 53724 - protein, 185 aa, Homo sapiens
  Payload ID: 10645
  Gene Symbol: MUTYH
  Gene Name: mutY DNA glycosylase
  ENSP ID: ENSP00000434985
MRKPRAAVGSGHRKQAASQEGRQKHAKNNSQAKPSACDAGLARQPEEVVLQASVSSYHLFRDVAEVTAFRGSLLSWYDQEKRDLPWRRRAEDEMDLDRRAYAGGESTLGWPGLLFSWPAAAGGSSEGGRGARGPHATYSRDPAAAPAWRGALHSWGHCLYRLWPGNRCGGWQRSTGAVPCPSHWC

SEQ ID NO: 53725 - protein, 184 aa, Homo sapiens
  Payload ID: 10645
  Gene Symbol: MUTYH
  Gene Name: mutY DNA glycosylase
  ENSP ID: ENSP00000435889
ATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECGFGDLRSQLPTLDSATCACLPRSPGTRPWEWSTSPERPAASPPGRRALPPVFWNSLGPLGPKFCWCRGPTQVCWQDCGSSRP

SEQ ID NO: 53726 - protein, 99 aa, Homo sapiens
  Payload ID: 10645
  Gene Symbol: MUTYH
  Gene Name: mutY DNA glycosylase
  ENSP ID: ENSP00000436430
AIMRKPRAAVGSGHRKQAASQEGRQKHAKNNSQAKPSACDGGRGARGPHATYSRDPAAAPAWRGALHSWGHCLYRLWPGNRCGGWQRSTGAVPCPSHWC

SEQ ID NO: 53727 - protein, 94 aa, Homo sapiens
  Payload ID: 10645
  Gene Symbol: MUTYH
  Gene Name: mutY DNA glycosylase
  ENSP ID: ENSP00000436469
MAYKAIMRKPRAAVGSGHRKQAASQEGRQKHAKNNSQAKPSACDGLARQPEEVVLQASVSSYHLFRDVAEVTAFRGSLLSWYDQEKRDLPWRRR

SEQ ID NO: 53728 - protein, 45 aa, Homo sapiens
  Payload ID: 10645
  Gene Symbol: MUTYH
  Gene Name: mutY DNA glycosylase
  ENSP ID: ENSP00000436478
MTPLVSRLSRLWVRWTCGHHEEATSSRGKWSQEAGSQPGREAEAC

SEQ ID NO: 53729 - protein, 54 aa, Homo sapiens
  Payload ID: 10645
  Gene Symbol: MUTYH
  Gene Name: mutY DNA glycosylase
  ENSP ID: ENSP00000436597
MTPLVSRLSRLWAIMRKPRAAVGSGHRKQAASQEGRQKHAKNNSQAKPSACDET

SEQ ID NO: 53730 - protein, 216 aa, Homo sapiens; identical to SEQ ID NO: 53720
  Payload ID: 10645
  Gene Symbol: MUTYH
  Gene Name: mutY DNA glycosylase
  ENSP ID: ENSP00000437093

SEQ ID NO: 53731 - protein, 54 aa, Homo sapiens; identical to SEQ ID NO: 53729
  Payload ID: 10645
  Gene Symbol: MUTYH
  Gene Name: mutY DNA glycosylase
  ENSP ID: ENSP00000437166

SEQ ID NO: 53732 - protein, 639 aa, Homo sapiens
  Payload ID: 10646
  Gene Symbol: MX1
  Gene Name: MX dynamin-like GTPase 1
  ENSP ID: ENSP00000288383
MVVSEVDIAKADPAAASHPLLLNGDATVAQKNPGSVAENNLCSQYEEKVRPCIDLIDSLRALGVEQDLALPAIAVIGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKVNAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKSKIEDIRAEQEREGEKLIRLHFQMEQIVYCQDQVYRGALQKVREKELEEEKKKKSWDFGAFQSSSATDSSMEEIFQHLMAYHQEASKRISSHIPLIIQFFMLQTYGQQLQKAMLQLLQDKDTYSWLLKERSDTSDKRKFLKERLARLTQARRRLAQFPG

SEQ ID NO: 53733 - protein, 662 aa, Homo sapiens
  Payload ID: 10646
  Gene Symbol: MX1
  Gene Name: MX dynamin-like GTPase 1
  Uniprot ID: P20591
  ENSP ID: ENSP00000381599
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKVNAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKSKIEDIRAEQEREGEKLIRLHFQMEQIVYCQDQVYRGALQKVREKELEEEKKKKSWDFGAFQSSSATDSSMEEIFQHLMAYHQEASKRISSHIPLIIQFFMLQTYGQQLQKAMLQLLQDKDTYSWLLKERSDTSDKRKFLKERLARLTQARRRLAQFPG

SEQ ID NO: 53734 - protein, 662 aa, Homo sapiens; identical to SEQ ID NO: 53733
  Payload ID: 10646
  Gene Symbol: MX1
  Gene Name: MX dynamin-like GTPase 1
  Uniprot ID: P20591
  ENSP ID: ENSP00000381601

SEQ ID NO: 53735 - protein, 25 aa, Homo sapiens
  Payload ID: 10646
  Gene Symbol: MX1
  Gene Name: MX dynamin-like GTPase 1
  ENSP ID: ENSP00000392151
MVVSEVDIAKADPAAASHPLLLNGD

SEQ ID NO: 53736 - protein, 77 aa, Homo sapiens
  Payload ID: 10646
  Gene Symbol: MX1
  Gene Name: MX dynamin-like GTPase 1
  ENSP ID: ENSP00000393931
MVVSEVDIAKADPAAASHPLLLNGDATVAQKNPGSVAENNLCSQYEEKVRPCIDLIDSLRALGVEQDLALPAIAVIG

SEQ ID NO: 53737 - protein, 197 aa, Homo sapiens
  Payload ID: 10646
  Gene Symbol: MX1
  Gene Name: MX dynamin-like GTPase 1
  ENSP ID: ENSP00000400923
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYK

SEQ ID NO: 53738 - protein, 201 aa, Homo sapiens
  Payload ID: 10646
  Gene Symbol: MX1
  Gene Name: MX dynamin-like GTPase 1
  ENSP ID: ENSP00000402215
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTL

SEQ ID NO: 53739 - protein, 68 aa, Homo sapiens
  Payload ID: 10646
  Gene Symbol: MX1
  Gene Name: MX dynamin-like GTPase 1
  ENSP ID: ENSP00000408498
MVVSEVDIAKADPAAASHPLLLNGDATVAQKNPGSVAENNLCSQYEEKVRPCIDLIDSLRALGVEQDL

SEQ ID NO: 53740 - protein, 662 aa, Homo sapiens; identical to SEQ ID NO: 53733
  Payload ID: 10646
  Gene Symbol: MX1
  Gene Name: MX dynamin-like GTPase 1
  Uniprot ID: P20591
  ENSP ID: ENSP00000410523

SEQ ID NO: 53741 - protein, 35 aa, Homo sapiens
  Payload ID: 10646
  Gene Symbol: MX1
  Gene Name: MX dynamin-like GTPase 1
  ENSP ID: ENSP00000410989
MVVSEVDIAKADPAAASHPLLLNGDATVAQKNPGS

SEQ ID NO: 53742 - protein, 508 aa, Homo sapiens
  Payload ID: 10646
  Gene Symbol: MX1
  Gene Name: MX dynamin-like GTPase 1
  Uniprot ID: P20591
  ENSP ID: ENSP00000478441
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKVNAFNQDITALMQGEETVGEEDIRLFTRLRHEFHKWSTIIENNFQEGGQQAHLQPHPFDHPVLHAPDVRPAASEGHAAAPAGQGHLQLAPEGAERHQRQAEVPEGAACTADAGSAPACPVPRLTTLCPAP

SEQ ID NO: 53743 - protein, 715 aa, Homo sapiens
  Payload ID: 10647
  Gene Symbol: MX2
  Gene Name: MX dynamin-like GTPase 2
  Uniprot ID: P20592
  ENSP ID: ENSP00000333657
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSSGKSSVLEALSGVALPRGSGIVTRCPLVLKLKKQPCEAWAGRISYRNTELELQDPGQVEKEIHKAQNVMAGNGRGISHELISLEITSPEVPDLTIIDLPGITRVAVDNQPRDIGLQIKALIKKYIQRQQTINLVVVPCNVDIATTEALSMAHEVDPEGDRTIGILTKPDLMDRGTEKSVMNVVRNLTYPLKKGYMIVKCRGQQEITNRLSLAEATKKEITFFQTHPYFRVLLEEGSATVPRLAERLTTELIMHIQKSLPLLEGQIRESHQKATEELRRCGADIPSQEADKMFFLIEKIKMFNQDIEKLVEGEEVVRENETRLYNKIREDFKNWVGILATNTQKVKNIIHEEVEKYEKQYRGKELLGFVNYKTFEIIVHQYIQQLVEPALSMLQKAMEIIQQAFINVAKKHFGEFFNLNQTVQSTIEDIKVKHTAKAENMIQLQFRMEQMVFCQDQIYSVVLKKVREEIFNPLGTPSQNMKLNSHFPSNESSVSSFTEIGIHLNAYFLETSKRLANQIPFIIQYFMLRENGDSLQKAMMQILQEKNRYSWLLQEQSETATKRRILKERIYRLTQARHALCQFSSKEIH

SEQ ID NO: 53744 - protein, 125 aa, Homo sapiens
  Payload ID: 10647
  Gene Symbol: MX2
  Gene Name: MX dynamin-like GTPase 2
  ENSP ID: ENSP00000389256
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIG

SEQ ID NO: 53745 - protein, 129 aa, Homo sapiens
  Payload ID: 10647
  Gene Symbol: MX2
  Gene Name: MX dynamin-like GTPase 2
  ENSP ID: ENSP00000393975
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSS

SEQ ID NO: 53746 - protein, 133 aa, Homo sapiens
  Payload ID: 10647
  Gene Symbol: MX2
  Gene Name: MX dynamin-like GTPase 2
  ENSP ID: ENSP00000410188
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSSGKSS

SEQ ID NO: 53747 - protein, 14 aa, Homo sapiens
  Payload ID: 10647
  Gene Symbol: MX2
  Gene Name: MX dynamin-like GTPase 2
  ENSP ID: ENSP00000411179
MSKAHKPWPYRRRS

SEQ ID NO: 53748 - protein, 1328 aa, Homo sapiens
  Payload ID: 10648
  Gene Symbol: MYBBP1A
  Gene Name: MYB binding protein (P160) 1a
  Uniprot ID: Q9BQG0
  ENSP ID: ENSP00000254718
MESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFRLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKSPAESCDLLGDIQTCIRKSLGEKPRRSRTKTIDPQEPPWVEVLVEILLALLAQPSHLMRQVARSVFGHICSHLTPRALQLILDVLNPETSEDENDRVVVTDDSDERRLKGAEDKSEEGEDNRSSESEEESEGEESEEEERDGDVDQGFREQLMTVLQAGKALGGEDSENEEELGDEAMMALDQSLASLFAEQKLRIQARRDEKNKLQKEKALRRDFQIRVLDLVEVLVTKQPENALVLELLEPLLSIIRRSLRSSSSKQEQDLLHKTARIFTHHLCRARRYCHDLGERAGALHAQVERLVQQAGRQPDSPTALYHFNASLYLLRVLKGNTAEGCVHETQEKQKAGTDPSHMPTGPQAASCLDLNLVTRVYSTALSSFLTKRNSPLTVPMFLSLFSRHPVLCQSLLPILVQHITGPVRPRHQACLLLQKTLSMREVRSCFEDPEWKQLMGQVLAKVTENLRVLGEAQTKAQHQQALSSLELLNVLFRTCKHEKLTLDLTVLLGVLQGQQQSLQQGAHSTGSSRLHDLYWQAMKTLGVQRPKLEKKDAKEIPSATQSPISKKRKKKGFLPETKKRKKRKSEDGTPAEDGTPAATGGSQPPSMGRKKRNRTKAKVPAQANGTPTTKSPAPGAPTRSPSTPAKSPKLQKKNQKPSQVNGAPGSPTEPAGQKQHQKALPKKGVLGKSPLSALARKKARLSLVIRSPSLLQSGAKKKAQVRKAGKP

SEQ ID NO: 53749 - protein, 1332 aa, Homo sapiens
  Payload ID: 10648
  Gene Symbol: MYBBP1A
  Gene Name: MYB binding protein (P160) 1a
  Uniprot ID: Q9BQG0
  ENSP ID: ENSP00000370968
MESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFRLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKSPAESCDLLGDIQTCIRKSLGEKPRRSRTKTIDPQEPPWVEVLVEILLALLAQPSHLMRQVARSVFGHICSHLTPRALQLILDVLNPETSEDENDRVVVTDDSDERRLKGAEDKSEEGEDNRSSESEEESEGEESEEEERDGDVDQGFREQLMTVLQAGKALGGEDSENEEELGDEAMMALDQSLASLFAEQKLRIQARRDEKNKLQKEKALRRDFQIRVLDLVEVLVTKQPENALVLELLEPLLSIIRRSLRSSSSKQEQDLLHKTARIFTHHLCRARRYCHDLGERAGALHAQVERLVQQAGRQPDSPTALYHFNASLYLLRVLKGNTAEGCVHETQEKQKAGTDPSHMPTGPQAASCLDLNLVTRVYSTALSSFLTKRNSPLTVPMFLSLFSRHPVLCQSLLPILVQHITGPVRPRHQACLLLQKTLSMREVRSCFEDPEWKQLMGQVLAKVTENLRVLGEAQTKAQHQQALSSLELLNVLFRTCKHEKLTLDLTVLLGVLQGQQQSLQQGAHSTGSSRLHDLYWQAMKTLGVQRPKLEKKDAKEIPSATQSPISKKRKKKGFLPETKKRKKRKSEDGTPAEDGTPAATGGSQPPSMGRKKRNRTKAKVPAQANGTPTTKSPAPGAPTRSPSTPAKSPKLQKKNQKPSQVNGAPGSPTEPAGQKQHQKALPKKGVLGKSPLSALARKKARLSLVIRSPSLLQSGAKKKAQTLRFTISSSKK

SEQ ID NO: 53750 - protein, 1252 aa, Homo sapiens
  Payload ID: 10648
  Gene Symbol: MYBBP1A
  Gene Name: MYB binding protein (P160) 1a
  ENSP ID: ENSP00000458919
  MOD_RES (1)..(1): Any amino acid
XGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFRLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKSPAESCDLLGDIQTCIRKSLGEKPRRSRTKTIDPQEPPWVEVLVEILLALLAQPSHLMRQVARSVFGHICSHLTPRALQLILDVLNPETSEDENDRVVVTDDSDERRLKGAEDKSEEGEDNRSSESEEESEGEESEEEERDGDVDQGFREQLMTVLQAGKALGGEDSENEEELGDEAMMALDQSLASLFAEQKLRIQARRDEKNKLQKEKALRRDFQIRVLDLVEVLVTKQPENALVLELLEPLLSIIRRSLRSSSSKQEQDLLHKTARIFTHHLCRARRYCHDLGERAGALHAQVERLVQQAGRQPDSPTALYHFNASLYLLRVLKGNTAEGCVHETQEKQKAGTDPSHMPTGPQAASCLDLNLVTRVYSTALSSFLTKRNSPLTVPMFLSLFSRHPVLCQSLLPILVQHITGPVRPRHQACLLLQKTLSMREVRSCFEDPEWKQLMGQVLAKVTENLRVLGEAQTKAQHQQALSSLELLNVLFRTCKHEKLTLDLTVLLGVLQGQQQSLQQGAHSTGSSRLHDLYWQAMKTLGVQRPKLEKKDAKEIPSATQSPISKKRKKKGFLPETKKRKKRKSEDGTPAEDGTPAATGGSQPPSMGRKKRNRTKAKVPAQANGTPTTKSPAPGAPTRSPSTPAKSPKLQKKNQKPSQVNGAPGSPTEPAGQKQHQKALPKKGVLGKSPLSALARKKARLSLVIRSPSLLQSGAKKKAQTLRFTISSSKK

SEQ ID NO: 53751 - protein, 204 aa, Homo sapiens
  Payload ID: 10648
  Gene Symbol: MYBBP1A
  Gene Name: MYB binding protein (P160) 1a
  ENSP ID: ENSP00000459692
  MOD_RES (1)..(1): Any amino acid
XMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQVNGAPGSPTEPAGQKQHQKALPKKGVLGKSPLSALARKKARLSLVIRSPSLLQSGAKKKAQTLRFTISSSK

SEQ ID NO: 53752 - protein, 69 aa, Homo sapiens
  Payload ID: 10648
  Gene Symbol: MYBBP1A
  Gene Name: MYB binding protein (P160) 1a
  ENSP ID: ENSP00000460087
  MOD_RES (1)..(1): Any amino acid
XSEGEESEEEERDGDVDQGFREQLMTVLQAGKPPARPLLAGHENPGSPAPQVGEEGCQGDPQCHPEPHQ

SEQ ID NO: 53753 - protein, 278 aa, Homo sapiens
  Payload ID: 10649
  Gene Symbol: MSANTD1
  Gene Name: Myb/SANT-like DNA-binding domain containing 1
  Uniprot ID: Q6ZTZ1
  ENSP ID: ENSP00000411584
MVRGAGPGPSLSALSHPTGASGMAAAEGPGYLVSPQAEKHRRARNWTDAEMRGLMLVWEEFFDELKQTKRNAKVYEKMASKLFEMTGERRLGEEIKIKITNMTFQYRKLKCMTDSESAPPDWPYYLAIDGILAKVPESCDGKLPDSQPPGPSTSQTEASLSPPAKSTPLYFPYNQCSYEGRFEDDRSDSSSSLLSLKFRSEERPVKKRKVQSCHLQKKQLRLLEAMVEEQRRLSRAVEETCREVRRVLDQQHILQVQSLQLQERMMSLLERIITKSSV

SEQ ID NO: 53754 - protein, 285 aa, Homo sapiens
  Payload ID: 10649
  Gene Symbol: MSANTD1
  Gene Name: Myb/SANT-like DNA-binding domain containing 1
  ENSP ID: ENSP00000420966
MVRGAGPGPSLSALSHPTGASGMAAAEGPGYLVSPQAEKHRRARNWTDAEMRGLMLVWEEFFDELKQTKRNAKVYEKMASKLFEMTGERRLGEEIKIKITNMTFQYRKLKCMTDSESAPPDWPYYLAIDGILAKVPESCDGKLPDSQPPGPSTSQTEASLSPPAKSTPLYFPYNQCSYEGRFEDDRSDSSSSLLSLKFRSEERPVKKRKVQSCHLQKKQLRLLEAMVEEQRRLSRAVEETCREVRRVLDQQHILQIQTAAQPIAHLHFLSVDVGQARLPVARAGR

SEQ ID NO: 53755 - protein, 265 aa, Homo sapiens
  Payload ID: 10649
  Gene Symbol: MSANTD1
  Gene Name: Myb/SANT-like DNA-binding domain containing 1
  ENSP ID: ENSP00000423547
MQLCQGASGMAAAEGPGYLVSPQAEKHRRARNWTDAEMRGLMLVWEEFFDELKQTKRNAKVYEKMASKLFEMTGERRLGEEIKIKITNMTFQYRKLKCMTDSESAPPDWPYYLAIDGILAKVPESCDGKLPDSQPPGPSTSQTEASLSPPAKSTPLYFPYNQCSYEGRFEDDRSDSSSSLLSLKFRSEERPVKKRKVQSCHLQKKQLRLLEAMVEEQRRLSRAVEETCREVRRVLDQQHILQVQSLQLQERMMSLLERIITKSSV

SEQ ID NO: 53756 - protein, 267 aa, Homo sapiens
  Payload ID: 10649
  Gene Symbol: MSANTD1
  Gene Name: Myb/SANT-like DNA-binding domain containing 1
  ENSP ID: ENSP00000425405
MVRGAGPGPSLSALSHPTGASGMAAAEGPGYLVSPQAEKHRRARNWTDAEMRGLMLVWEEFFDELKQTKRNAKVYEKMASKLFEMTGERRLGEEIKIKITNMTFQYRKLKCMTDSESAPPDWPYYLAIDGILAKVPESCDGKLPDSQPPGPSTSQTEASLSPPAKSTPLYFPYNQCSYEGRFEDDRSDSSSSLLSLKFRSEERPVKKRKVQSCHLQKKQLRLLEAMVEEQRRLSRAVEETCREISRCYSTVCRRGCPVAMEWLWTLS

SEQ ID NO: 53757 - protein, 507 aa, Homo sapiens
  Payload ID: 10650
  Gene Symbol: MSANTD2
  Gene Name: Myb/SANT-like DNA-binding domain containing 2
  Uniprot ID: Q6P1R3
  ENSP ID: ENSP00000239614
MAAPCGSELPANSPLKIPKMEVLSPASPGGLSDGNPSLSDPSTPRGASPLGPGSAAGSGAAASGGLGLGLGGRSAASSSVSFSPGGGGGGAAAAAAAACRGMSWTPAETNALIAVWGNERLVEARYQQLEGAGTVFGSKAPGPAMYERVSRALAELGYERTPSQCRERIKELESDGSTMEDYSQEDWGNHSQDLHGYPTDQELDEIPVTKRTLKIKQESSEEAQKRDIMQNIVQILESVQLKWELFQSWTDFSRLHLSNKLAIFGIGYNTRWKEDIRYHYAEISSQVPLGKRLREYFNSEKPEGRIIMTRVQKMNWKNVYYKFLEITISEARCLELHMEIDWIPIAHSKPTGGNVVQYLLPGGIPKSPGLYAIGYEECIERPLSPHMEQSSLDPGKEGRVDLETLSAQASLQVEIEPTRIIYCYLGIAEVRTLQQCLFLHFQANTKTFSKDWVGINGFLSQNCIVDPGVSPKSIYIKFVEVERDFLSAGSLVECLEKAIGYPLKFNN

SEQ ID NO: 53758 - protein, 559 aa, Homo sapiens
  Payload ID: 10650
  Gene Symbol: MSANTD2
  Gene Name: Myb/SANT-like DNA-binding domain containing 2
  Uniprot ID: Q6P1R3
  ENSP ID: ENSP00000364118
MAAPCGSELPANSPLKIPKMEVLSPASPGGLSDGNPSLSDPSTPRGASPLGPGSAAGSGAAASGGLGLGLGGRSAASSSVSFSPGGGGGGAAAAAAAACRGMSWTPAETNALIAVWGNERLVEARYQQLEGAGTVFGSKAPGPAMYERVSRALAELGYERTPSQCRERIKTLRRCYSRVKEHGVGKRKSSYTFEQLEQVFGQGGWDAQPCQPVLINSSGLYQELESDGSTMEDYSQEDWGNHSQDLHGYPTDQELDEIPVTKRTLKIKQESSEEAQKRDIMQNIVQILESVQLKWELFQSWTDFSRLHLSNKLAIFGIGYNTRWKEDIRYHYAEISSQVPLGKRLREYFNSEKPEGRIIMTRVQKMNWKNVYYKFLEITISEARCLELHMEIDWIPIAHSKPTGGNVVQYLLPGGIPKSPGLYAIGYEECIERPLSPHMEQSSLDPGKEGRVDLETLSAQASLQVEIEPTRIIYCYLGIAEVRTLQQCLFLHFQANTKTFSKDWVGINGFLSQNCIVDPGVSPKSIYIKFVEVERDFLSAGSLVECLEKAIGYPLKFNN

SEQ ID NO: 53759 - protein, 179 aa, Homo sapiens
  Payload ID: 10650
  Gene Symbol: MSANTD2
  Gene Name: Myb/SANT-like DNA-binding domain containing 2
  ENSP ID: ENSP00000431707
MAAPCGSELPANSPLKIPKMEVLSPASPGGLSDGNPSLSDPSTPRGASPLGPGSAAGSGAAASGGLGLGLGGRSAASSSVSFSPGGGGGGAAAAAAAACRGMSWTPAETNALIAVWGNERLVEARYQQLEGAGTVFGSKAPGPAMYERVSRALAELGYERTPSQCRERIKMKYLSQREH

SEQ ID NO: 53760 - protein, 208 aa, Homo sapiens
  Payload ID: 10650
  Gene Symbol: MSANTD2
  Gene Name: Myb/SANT-like DNA-binding domain containing 2
  ENSP ID: ENSP00000434572
MAAPCGSELPANSPLKIPKMEVLSPASPGGLSDGNPSLSDPSTPRGASPLGPGSAAGSGAAASGGLGLGLGGRSAASSSVSFSPGGGGGGAAAAAAAACRGMSWTPAETNALIAVWGNERLVEARYQQLEGAGTVFGSKAPGPAMYERVSRALAELGYERTPSQCRERIKWLVPGAGVRWQHYGGLFTGGLGKPQSGSPWLSNRSGIG

SEQ ID NO: 53761 - protein, 329 aa, Homo sapiens
  Payload ID: 10650
  Gene Symbol: MSANTD2
  Gene Name: Myb/SANT-like DNA-binding domain containing 2
  Uniprot ID: Q6P1R3
  ENSP ID: ENSP00000435705
MEDYSQEDWGNHSQDLHGYPTDQELDEIPVTKRTLKIKQESSEEAQKRDIMQNIVQILESVQLKWELFQSWTDFSRLHLSNKLAIFGIGYNTRWKEDIRYHYAEISSQVPLGKRLREYFNSEKPEGRIIMTRVQKMNWKNVYYKFLEITISEARCLELHMEIDWIPIAHSKPTGGNVVQYLLPGGIPKSPGLYAIGYEECIERPLSPHMEQSSLDPGKEGRVDLETLSAQASLQVEIEPTRIIYCYLGIAEVRTLQQCLFLHFQANTKTFSKDWVGINGFLSQNCIVDPGVSPKSIYIKFVEVERDFLSAGSLVECLEKAIGYPLKFNN

SEQ ID NO: 53762 - protein, 159 aa, Homo sapiens
  Payload ID: 10651
  Gene Symbol: MSANTD3
  Gene Name: Myb/SANT-like DNA-binding domain containing 3
  Uniprot ID: Q96H12
  ENSP ID: ENSP00000364020
MQNNEIIKPAKYFSELEKSILLALVEKYKYVLECKKSDARTIALKQRTWQALAHEYNSQPSVSLRDFKQLKKCWENIKARTKKIMAHERREKVKRSVSPLLSTHVLGKEKIASMLPEQLYFLQSPPEEEPEYHPDASAQVFFQERKRSLELSIILSGTW

SEQ ID NO: 53763 - protein, 181 aa, Homo sapiens
  Payload ID: 10651
  Gene Symbol: MSANTD3
  Gene Name: Myb/SANT-like DNA-binding domain containing 3
  ENSP ID: ENSP00000364021
MQNNEIIKPAKYFSELEKSILLALVEKYKYVLECKKSDARTIALKQRTWQALAHEYNSQPSVSLRDFKQLKKCWENIKARTKKIMAHERREKVKRSVSPLLSTHVLGKEKIASMLPEQLYFLQSPPEEEPEYHPDASAQESFAVSNRELCDDEKEFIHFPVCEGTSQPEPSCSAVRITANK

SEQ ID NO: 53764 - protein, 275 aa, Homo sapiens
  Payload ID: 10651
  Gene Symbol: MSANTD3
  Gene Name: Myb/SANT-like DNA-binding domain containing 3
  Uniprot ID: Q96H12
  ENSP ID: ENSP00000378506
MQNNEIIKPAKYFSELEKSILLALVEKYKYVLECKKSDARTIALKQRTWQALAHEYNSQPSVSLRDFKQLKKCWENIKARTKKIMAHERREKVKRSVSPLLSTHVLGKEKIASMLPEQLYFLQSPPEEEPEYHPDASAQESFAVSNRELCDDEKEFIHFPVCEGTSQPEPSCSAVRITANKNYRSKTSQEGALKKMHEEEHHQQMSILQLQLIQMNEVHVAKIQQIERECEMAEEEHRIKMEVLNKKKMYWERKLQTFTKEWPVSSFNRPFPNSP

SEQ ID NO: 53765 - protein, 134 aa, Homo sapiens
  Payload ID: 10651
  Gene Symbol: MSANTD3
  Gene Name: Myb/SANT-like DNA-binding domain containing 3
  ENSP ID: ENSP00000415830
MQNNEIIKPAKYFSELEKSILLALVEKYKYVLECKKSDARTIALKQRTWQALAHEYNSQPSVSLRDFKQLKKCWENIKARTKKIMAHERREKVKRSVSPLLSTHVLGKEKIASMLPEQLYFLQSPPEEEPEYHP

SEQ ID NO: 53766 - protein, 275 aa, Homo sapiens; identical to SEQ ID NO: 53764
  Payload ID: 10651
  Gene Symbol: MSANTD3
  Gene Name: Myb/SANT-like DNA-binding domain containing 3
  Uniprot ID: Q96H12
  ENSP ID: ENSP00000480445

SEQ ID NO: 53767 - protein, 275 aa, Homo sapiens; identical to SEQ ID NO: 53764
  Payload ID: 10651
  Gene Symbol: MSANTD3
  Gene Name: Myb/SANT-like DNA-binding domain containing 3
  Uniprot ID: Q96H12
  ENSP ID: ENSP00000480622

SEQ ID NO: 53768 - protein, 345 aa, Homo sapiens
  Payload ID: 10652
  Gene Symbol: MSANTD4
  Gene Name: Myb/SANT-like DNA-binding domain containing 4 with coiled-coils
  Uniprot ID: Q8NCY6
  ENSP ID: ENSP00000304713
MKQLKRKRKSNFSVQETQTLLKEITKRKEVIFSKQLNTTINVMKRMAWEEIAQCVNAVGEGEQRTGTEVKRRYLDWRALMKRKRMKANIKLVGSGFPLPSSDLDDSLTEEIDEKIGFRNDANFDWQNVADFRDAGGSLTEVKVEEEERDPQSPEFEIEEEEEMLSSVIPDSRRENELPDFPHIDEFFTLNSTPSRSAYDEPHLLVNIEKQKLELEKRRLDIEAERLQVEKERLQIEKERLRHLDMEHERLQLEKERLQIEREKLRLQIVNSEKPSLENELGQGEKSMLQPQDIETEKLKLERERLQLEKDRLQFLKFESEKLQIEKERLQVEKDRLRIQKEGHLQ

SEQ ID NO: 53769 - protein, 111 aa, Homo sapiens
  Payload ID: 10652
  Gene Symbol: MSANTD4
  Gene Name: Myb/SANT-like DNA-binding domain containing 4 with coiled-coils
  ENSP ID: ENSP00000432245
MKQLKRKRKSNFSVQETQTLLKEITKRKEVIFSKQLNTTINVMKRMAWEEIAQCVNAVGEGEQRTGTEVKRRYLDWRALMKRKRMKANIKLVGSGFPLPSSDLDDSLTEEI

SEQ ID NO: 53770 - protein, 196 aa, Homo sapiens
  Payload ID: 10652
  Gene Symbol: MSANTD4
  Gene Name: Myb/SANT-like DNA-binding domain containing 4 with coiled-coils
  ENSP ID: ENSP00000435125
MKQLKRKRKSNFSVQETQTLLKEITKRKEVIFSKQLNTTINVMKRMAWEEIAQCVNAVGEGEQRTGTEVKRRYLDWRALMKRKRMKANIKLVGSGFPLPSSDLDDSLTEEIDEKIGFRNDANFDWQNVADFRDAGGSLTEVKVEEEERDPQSPEFEIEEEEEMLSSVIPDSRRENELPDFPHIDEFFTLNSTPSRS

SEQ ID NO: 53771 - protein, 71 aa, Homo sapiens
  Payload ID: 10652
  Gene Symbol: MSANTD4
  Gene Name: Myb/SANT-like DNA-binding domain containing 4 with coiled-coils
  ENSP ID: ENSP00000435372
MKQLKRKRKSNFSVQETQTLLKEITKRKEVIFSKQLNTTINVMKRMAWEEIAQCVNAVGEGEQRTGTEVKR

SEQ ID NO: 53772 - protein, 134 aa, Homo sapiens
  Payload ID: 10652
  Gene Symbol: MSANTD4
  Gene Name: Myb/SANT-like DNA-binding domain containing 4 with coiled-coils
  ENSP ID: ENSP00000482795
MKRLDSEMMNFDWQNVADFRDAGGSLTEVKVEEEERDPQSPEFEIEEEEEMLSSVIPDSRRENELPDFPHIDEFFTLNSTPSRSAYDEPHLLVNIEKQKLELEKRRLDIEAERAGRKGTPTNREREAAAFRHGT

SEQ ID NO: 53773 - protein, 828 aa, Homo sapiens
  Payload ID: 10653
  Gene Symbol: MYSM1
  Gene Name: Myb-like, SWIRM and MPN domains 1
  Uniprot ID: Q5VVJ2
  ENSP ID: ENSP00000418734
MAAEEADVDIEGDVVAAAGAQPGSGENTASVLQKDHYLDSSWRTENGLIPWTLDNTISEENRAVIEKMLLEEEYYLSKKSQPEKVWLDQKEDDKKYMKSLQKTAKIMVHSPTKPASYSVKWTIEEKELFEQGLAKFGRRWTKISKLIGSRTVLQVKSYARQYFKNKVKCGLDKETPNQKTGHNLQVKNEDKGTKAWTPSCLRGRADPNLNAVKIEKLSDDEEVDITDEVDELSSQTPQKNSSSDLLLDFPNSKMHETNQGEFITSDSQEALFSKSSRGCLQNEKQDETLSSSEITLWTEKQSNGDKKSIELNDQKFNELIKNCNKHDGRGIIVDARQLPSPEPCEIQKNLNDNEMLFHSCQMVEESHEEEELKPPEQEIEIDRNIIQEEEKQAIPEFFEGRQAKTPERYLKIRNYILDQWEICKPKYLNKTSVRPGLKNCGDVNCIGRIHTYLELIGAINFGCEQAVYNRPQTVDKVRIRDRKDAVEAYQLAQRLQSMRTRRRRVRDPWGNWCDAKDLEGQTFEHLSAEELAKRREEEKGRPVKSLKVPRPTKSSFDPFQLIPCNFFSEEKQEPFQVKVASEALLIMDLHAHVSMAEVIGLLGGRYSEVDKVVEVCAAEPCNSLSTGLQCEMDPVSQTQASETLAVRGFSVIGWYHSHPAFDPNPSLRDIDTQAKYQSYFSRGGAKFIGMIVSPYNRNNPLPYSQITCLVISEEISPDGSYRLPYKFEVQQMLEEPQWGLVFEKTRWIIEKYRLSHSSVPMDKIFRRDSDLTCLQKLLECMRKTLSKVTNCFMAEEFLTEIENLFLSNYKSNQENGVTEENCTKELLM

SEQ ID NO: 53774 - protein, 234 aa, Homo sapiens
  Payload ID: 10653
  Gene Symbol: MYSM1
  Gene Name: Myb-like, SWIRM and MPN domains 1
  Uniprot ID: Q5VVJ2
  ENSP ID: ENSP00000478391
MAEVIGLLGGRYSEVDKVVEVCAAEPCNSLSTGLQCEMDPVSQTQASETLAVRGFSVIGWYHSHPAFDPNPSLRDIDTQAKYQSYFSRGGAKFIGMIVSPYNRNNPLPYSQITCLVISEEISPDGSYRLPYKFEVQQMLEEPQWGLVFEKTRWIIEKYRLSHSSVPMDKIFRRDSDLTCLQKLLECMRKTLSKVTNCFMAEEFLTEIENLFLSNYKSNQENGVTEENCTKELLM

SEQ ID NO: 53775 - protein, 399 aa, Homo sapiens
  Payload ID: 10654
  Gene Symbol: MYPOP
  Gene Name: Myb-related transcription factor, partner of profilin
  Uniprot ID: Q86VE0
  ENSP ID: ENSP00000325402
MASAAAGEAEETTRLRKPRFSFEENQILIREVRAHYPQLYGAQSRRVSVAERRRVWDGIAAKINGITSWKRTGQEVQKRWNDFKRRTKEKLARVPHSTQGAGPAAEDAFSAEEETIFAILGPGVAAPGAGAGAEEPPAAPSSQPPPPSACPQRYVLSEDRREDRRADTSAHSKAGSSSPEPWARPSCTPQEGGCPRPKERESPPPSALQPVQLPRLALSPPPPAPPLPPPPPLAQVAPSPPSPPPPPRPPPTLSASDPSLDFLRAQQETANAIRELAGTLRQGLAKLSEALSALLPLLPGTPVDSLPPPLPPPPPPPPPPRPVLPPPAPKVEITPEPVSVVAAVVDGAVVAARGVIIAPRSEEGAPRPPPAPLPPHDSPPHKRRKGFPTRKRRGRWKSP

SEQ ID NO: 53776 - protein, 96 aa, Homo sapiens
  Payload ID: 10655
  Gene Symbol: MAX
  Gene Name: MYC associated factor X
  Uniprot ID: P61244
  ENSP ID: ENSP00000246163
MSDNDDIEVESDEEQPRFQSAADKRAHHNALERKRRDHIKDSFHSLRDSVPSLQGEKLYFLFWKLCTPVLHRQSLMQKCHTFISSYQVHKKKECKI

SEQ ID NO: 53777 - protein, 134 aa, Homo sapiens
  Payload ID: 10655
  Gene Symbol: MAX
  Gene Name: MYC associated factor X
  Uniprot ID: P61244
  ENSP ID: ENSP00000284165
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQGEHPSSWGSWPCCAPARSGFGTWACRVRASHGVCAQ

SEQ ID NO: 53778 - protein, 83 aa, Homo sapiens
  Payload ID: 10655
  Gene Symbol: MAX
  Gene Name: MYC associated factor X
  Uniprot ID: P61244
  ENSP ID: ENSP00000342482
MSDNDDIEVESDEEQPRFQSAADKRAHHNALERKRRDHIKDSFHSLRDSVPSLQGEKGTKMKLTLPPVFPYEHLPFPTVFCHG

SEQ ID NO: 53779 - protein, 151 aa, Homo sapiens
  Payload ID: 10655
  Gene Symbol: MAX
  Gene Name: MYC associated factor X
  Uniprot ID: P61244
  ENSP ID: ENSP00000351175
MSDNDDIEVESDADKRAHHNALERKRRDHIKDSFHSLRDSVPSLQGEKASRAQILDKATEYIQYMRRKNHTHQQDIDDLKRQNALLEQQVRALEKARSSAQLQTNYPSSDNSLYTNAKGSTISAFDGGSDSSSESEPEEPQSRKKLRMEAS

SEQ ID NO: 53780 - protein, 160 aa, Homo sapiens
  Payload ID: 10655
  Gene Symbol: MAX
  Gene Name: MYC associated factor X
  Uniprot ID: P61244
  ENSP ID: ENSP00000351490
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQVRALEKARSSAQLQTNYPSSDNSLYTNAKGSTISAFDGGSDSSSESEPEEPQSRKKLRMEAS

SEQ ID NO: 53781 - protein, 103 aa, Homo sapiens
  Payload ID: 10655
  Gene Symbol: MAX
  Gene Name: MYC associated factor X
  Uniprot ID: P61244
  ENSP ID: ENSP00000378104
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQGESES

SEQ ID NO: 53782 - protein, 82 aa, Homo sapiens
  Payload ID: 10655
  Gene Symbol: MAX
  Gene Name: MYC associated factor X
  ENSP ID: ENSP00000450763
MSDNDDIEVESDSVHWRRRGQVPNCRPTTPPQTTASTPTPRAAPSLPSMGARTPARSLSLKSPKAGRSSGWRPAKPLGAGQQ

SEQ ID NO: 53783 - protein, 125 aa, Homo sapiens
  Payload ID: 10655
  Gene Symbol: MAX
  Gene Name: MYC associated factor X
  ENSP ID: ENSP00000450818
MSDNDDIEVESDADKRAHHNALERKRRDHIKDSFHSLRDSVPSLQGEKASRAQILDKATEYIQYMRRKNHTHQQDIDDLKRQNALLEQQGEHPSSWGSWPCCAPARSGFGTWACRVRASHGVCAQ

SEQ ID NO: 53784 - protein, 97 aa, Homo sapiens
  Payload ID: 10655
  Gene Symbol: MAX
  Gene Name: MYC associated factor X
  ENSP ID: ENSP00000450955
MLFWSSKGKARADQVLCSWGIHFSSSLMEDASKRKFRALEKARSSAQLQTNYPSSDNSLYTNAKGSTISAFDGGSDSSSESEPEEPQSRKKLRMEAS

SEQ ID NO: 53785 - protein, 103 aa, Homo sapiens; identical to SEQ ID NO: 53781
  Payload ID: 10655
  Gene Symbol: MAX
  Gene Name: MYC associated factor X
  Uniprot ID: P61244
  ENSP ID: ENSP00000451907

SEQ ID NO: 53786 - protein, 121 aa, Homo sapiens
  Payload ID: 10655
  Gene Symbol: MAX
  Gene Name: MYC associated factor X
  ENSP ID: ENSP00000452197
MSDNDDIEVESDADKRAHHNALERKRRDHIKDSFHSLRDSVPSLQGEKASRAQILDKATEYIQYMRRKNHTHQQDIDDLKRQNALLEQQGALPAVGITPGIRCLKRALRSLEWNVLWESES

SEQ ID NO: 53787 - protein, 43 aa, Homo sapiens
  Payload ID: 10655
  Gene Symbol: MAX
  Gene Name: MYC associated factor X
  ENSP ID: ENSP00000452206
MRRKNHTHQQDIDDLKRQNALLEQQVRALEKARSSAQLQTNYP

SEQ ID NO: 53788 - protein, 94 aa, Homo sapiens
  Payload ID: 10655
  Gene Symbol: MAX
  Gene Name: MYC associated factor X
  ENSP ID: ENSP00000452286
MSDNDDIEVESDADKRAHHNALERKRRDHIKDSFHSLRDSVPSLQGEKASRAQILDKATEYIQYMRRKNHTHQQDIDDLKRQNALLEQQGESES

SEQ ID NO: 53789 - protein, 103 aa, Homo sapiens; identical to SEQ ID NO: 53781
  Payload ID: 10655
  Gene Symbol: MAX
  Gene Name: MYC associated factor X
  Uniprot ID: P61244
  ENSP ID: ENSP00000452378

SEQ ID NO: 53790 - protein, 124 aa, Homo sapiens
  Payload ID: 10655
  Gene Symbol: MAX
  Gene Name: MYC associated factor X
  ENSP ID: ENSP00000452405
MSDNDDIEVESDEEQPRFQSAASRAQILDKATEYIQYMRRKNHTHQQDIDDLKRQNALLEQQVRALEKARSSAQLQTNYPSSDNSLYTNAKGSTISAFDGGSDSSSESEPEEPQSRKKLRMEAS

SEQ ID NO: 53791 - protein, 103 aa, Homo sapiens; identical to SEQ ID NO: 53781
  Payload ID: 10655
  Gene Symbol: MAX
  Gene Name: MYC associated factor X
  Uniprot ID: P61244
  ENSP ID: ENSP00000480127

SEQ ID NO: 53792 - protein, 103 aa, Homo sapiens
  Payload ID: 10656
  Gene Symbol: MYCBP
  Gene Name: MYC binding protein
  Uniprot ID: Q99417
  ENSP ID: ENSP00000380702
MAHYKAADSKREQFRRYLEKSGVLDTLTKVLVALYEEPEKPNSALDFLKHHLGAATPENPEIELLRLELAEMKEKYEAIVEENKKLKAKLAQYEPPQEEKRAE

SEQ ID NO: 53793 - protein, 56 aa, Homo sapiens
  Payload ID: 10656
  Gene Symbol: MYCBP
  Gene Name: MYC binding protein
  ENSP ID: ENSP00000485717
MAHYKAADSKREQFRRYLEKSGVLDTLTKASLRSCYSRKSRNRAASPRTGRNEREV

SEQ ID NO: 53794 - protein, 4640 aa, Homo sapiens
  Payload ID: 10657
  Gene Symbol: MYCBP2
  Gene Name: MYC binding protein 2, E3 ubiquitin protein ligase
  Uniprot ID: O75592
  ENSP ID: ENSP00000349892
MPVPDGSVAAAGLGLGLPAADSRGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEGLQSEPPEVLESLFQLLLEITVRSTGMNDSTGQSLTALSCACLFSLVASWGETGRTLQAISAILTNNGSHACQTIQVPTILNSLQRSVQAVLVGKIQIQDWFSNGIKKAALMHKWPLKEISVDEDDQCLLQNDGFFLYLLCKDGLYKIGSGYSGTVRGHIYNSTSRIRNRKEKKSWLGYAQGYLLYRDVNNHSMTAIRISPETLEQDGTVMLPDCHTEGQNILFTDGEYINQIAASRDDGFVVRIFATSTEPVLQQELQLKLARKCLHACGISLFDLEKDLHIISTGFDEESAILGAGREFALMKTANGKIYYTGKYQSLGIKQGGPSAGKWVELPITKSPKIVHFSVGHDGSHALLVAEDGSIFFTGSASKGEDGESTKSRRQSKPYKPKKIIKMEGKIVVYTACNNGSSSVISKDGELYMFGKDAIYSDSSSLVTDLKGHFVTQVAMGKAHTCVLMKNGEVWTFGVNNKGQCGRDTGAMNQGGKGFGVENMATAMDEDLEEELDEKDEKSMMCPPGMHKWKLEQCMVCTVCGDCTGYGASCVSSGRPDRVPGGICGCGSGESGCAVCGCCKACARELDGQEARQRGILDAVKEMIPLDLLLAVPVPGVNIEEHLQLRQEEKRQRVIRRHRLEEGRGPLVFAGPIFMNHREQALARLRSHPAQLKHKRDKHKDGSGERGEKDASKITTYPPGSVRFDCELRAVQVSCGFHHSVVLMENGDVYTFGYGQHGQLGHGDVNSRGCPTLVQALPGPSTQVTAGSNHTAVLLMDGQVFTFGSFSKGQLGRPILDVPYWNAKPAPMPNIGSKYGRKATWIGASGDQTFLRIDEALINSHVLATSEIFASKHIIGLVPASISEPPPFKCLLINKVDGSCKTFNDSEQEDLQGFGVCLDPVYDVIWRFRPNTRELWCYNAVVADARLPSAADMQSRCSILSPELALPTGSRALTTRSHAALHILGCLDTLAAMQDLKMGVASTEEETQAVMKVYSKEDYSVVNRFESHGGGWGYSAHSVEAIRFSADTDILLGGLGLFGGRGEYTAKIKLFELGPDGGDHETDGDLLAETDVLAYDCAAREKYAMMFDEPVLLQAGWWYVAWARVSGPSSDCGSHGQASITTDDGVVFQFKSSKKSNNGTDVNAGQIPQLLYRLPTSDGSASKGKQQTSEPVHILKRSFARTVSVECFESLLSILHWSWTTLVLGVEELRGLKGFQFTATLLDLERLRFVGTCCLRLLRVYTCEIYPVSATGKAVVEETSKLAECIGKTRTLLRKILSEGVDHCMVKLDNDPQGYLSQPLSLLEAVLQECHNTFTACFHSFYPTPALQWACLCDLLNCLDQDIQEANFKTSSSRLLAAVMSALCHTSVKLTSIFPIAYDGEVLLRSIVKQVSTENDSTLVHRFPLLVAHMEKLSQSEENISGMTSFREVLEKMLVIVVLPVRNSLRRENELFSSHLVSNTCGLLASIVSELTASALGSEVDGLNSLHSVKASANRFTKTSQGRSWNTGNGSPDAICFSVDKPGIVVVGFSVYGGGGIHEYELEVLVDDSEHAGDSTHSHRWTSLELVKGTYTTDDSPSDIAEIRLDKVVPLKENVKYAVRLRNYGSRTANGDGGMTTVQCPDGVTFTFSTCSLSSNGTNQTRGQIPQILYYRSEFDGDLQSQLLSKANEEDKNCSRALSVVSTVVRASKDLLHRALAVDADDIPELLSSSSLFSMLLPLIIAYIGPVAAAIPKVAVEVFGLVQQLLPSVAILNQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADCQEYAKIACSKTHPCGHPCGGVKNEEHCLPCLHGCDKSATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 53795 - protein, 1061 aa, Homo sapiens
  Payload ID: 10657
  Gene Symbol: MYCBP2
  Gene Name: MYC binding protein 2, E3 ubiquitin protein ligase
  ENSP ID: ENSP00000413907
  MOD_RES (1)..(1): Any amino acid
XNKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADCQEYAKIACSKTHPCGHPCGGVKNEEHCLPCLHGCDKSATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 53796 - protein, 4640 aa, Homo sapiens; identical to SEQ ID NO: 53794
  Payload ID: 10657
  Gene Symbol: MYCBP2
  Gene Name: MYC binding protein 2, E3 ubiquitin protein ligase
  Uniprot ID: O75592
  ENSP ID: ENSP00000444596

SEQ ID NO: 53797 - protein, 83 aa, Homo sapiens
  Payload ID: 10657
  Gene Symbol: MYCBP2
  Gene Name: MYC binding protein 2, E3 ubiquitin protein ligase
  ENSP ID: ENSP00000481482
  MOD_RES (1)..(1): Any amino acid
XSMVEFCESDEGEAWSLARDRGGNQYLRHEDEQALLDQNSQTPPPSPFSVQAFNKGASCSAQGFDYGLGNSKGRYLKVSLLLT

SEQ ID NO: 53798 - protein, 275 aa, Homo sapiens
  Payload ID: 10657
  Gene Symbol: MYCBP2
  Gene Name: MYC binding protein 2, E3 ubiquitin protein ligase
  ENSP ID: ENSP00000483488
MCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCEMPTLFRTRRSFVYREKNCLHPPRGCGEV

SEQ ID NO: 53799 - protein, 465 aa, Homo sapiens
  Payload ID: 10658
  Gene Symbol: MINA
  Gene Name: MYC induced nuclear antigen
  Uniprot ID: Q8IUF8
  ENSP ID: ENSP00000328251
MPKKAKPTGSGKEEGPAPCKQMKLEAAGGPSALNFDSPSSLFESLISPIKTETFFKEFWEQKPLLIQRDDPALATYYGSLFKLTDLKSLCSRGMYYGRDVNVCRCVNGKKKVLNKDGKAHFLQLRKDFDQKRATIQFHQPQRFKDELWRIQEKLECYFGSLVGSNVYITPAGSQGLPPHYDDVEVFILQLEGEKHWRLYHPTVPLAREYSVEAEERIGRPVHEFMLKPGDLLYFPRGTIHQADTPAGLAHSTHVTISTYQNNSWGDFLLDTISGLVFDTAKEDVELRTGIPRQLLLQVESTTVATRRLSGFLRTLADRLEGTKELLSSDMKKDFIMHRLPPYSAGDGAELSTPGGKLPRLDSVVRLQFKDHIVLTVLPDQDQSDEAQEKMVYIYHSLKNSRETHMMGNEEETEFHGLRFPLSHLDALKQIWNSPAISVKDLKLTTDEEKESLVLSLWTECLIQVV

SEQ ID NO: 53800 - protein, 464 aa, Homo sapiens
  Payload ID: 10658
  Gene Symbol: MINA
  Gene Name: MYC induced nuclear antigen
  Uniprot ID: Q8IUF8
  ENSP ID: ENSP00000353395
MPKKAKPTGSGKEEGPAPCKQMKLEAAGGPSALNFDSPSSLFESLISPIKTETFFKEFWEQKPLLIQRDDPALATYYGSLFKLTDLKSLCSRGMYYGRDVNVCRCVNGKKKVLNKDGKAHFLQLRKDFDQKRATIQFHQPQRFKDELWRIQEKLECYFGSLVGSNVYITPAGSQGLPPHYDDVEVFILQLEGEKHWRLYHPTVPLAREYSVEAEERIGRPVHEFMLKPGDLLYFPRGTIHQADTPAGLAHSTHVTISTYQNNSWGDFLLDTISGLVFDTAKEDVELRTGIPRQLLLVESTTVATRRLSGFLRTLADRLEGTKELLSSDMKKDFIMHRLPPYSAGDGAELSTPGGKLPRLDSVVRLQFKDHIVLTVLPDQDQSDEAQEKMVYIYHSLKNSRETHMMGNEEETEFHGLRFPLSHLDALKQIWNSPAISVKDLKLTTDEEKESLVLSLWTECLIQVV

SEQ ID NO: 53801 - protein, 465 aa, Homo sapiens; identical to SEQ ID NO: 53799
  Payload ID: 10658
  Gene Symbol: MINA
  Gene Name: MYC induced nuclear antigen
  Uniprot ID: Q8IUF8
  ENSP ID: ENSP00000377748

SEQ ID NO: 53802 - protein, 27 aa, Homo sapiens
  Payload ID: 10658
  Gene Symbol: MINA
  Gene Name: MYC induced nuclear antigen
  ENSP ID: ENSP00000421347
TTLSSQYCRIKINLMKLKKRWCTSIIP

SEQ ID NO: 53803 - protein, 112 aa, Homo sapiens
  Payload ID: 10658
  Gene Symbol: MINA
  Gene Name: MYC induced nuclear antigen
  ENSP ID: ENSP00000423816
MPKKAKPTGSGKEEGPAPCKQMKLEAAGGPSALNFDSPSSLFESLISPIKTETFFKEFWEQKPLLIQRDDPALATYYGSLFKLTDLKSLCSRGMYYGRDVNVCRCVNGKKKV

SEQ ID NO: 53804 - protein, 108 aa, Homo sapiens
  Payload ID: 10658
  Gene Symbol: MINA
  Gene Name: MYC induced nuclear antigen
  ENSP ID: ENSP00000424530
ECYFGSLVGSNVYITPAGSQGLPPHYDDVEVFILQLEGEKHWRLYHPTVPLAREYSVEAEERIGRPVHEFMLKPGDLLYFPRGTIHQADTPAGLAHSTHVTISTYQNK

SEQ ID NO: 53805 - protein, 280 aa, Homo sapiens
  Payload ID: 10658
  Gene Symbol: MINA
  Gene Name: MYC induced nuclear antigen
  Uniprot ID: Q8IUF8
  ENSP ID: ENSP00000424955
MPKKAKPTGSGKEEGPAPCKQMKLEAAGGPSALNFDSPSSLFESLISPIKTETFFKEFWEQKPLLIQRDDPALATYYGSLFKLTDLKSLCSRGMYYGRDVNVCRCVNGKKKVLNKDGKAHFLQLRKDFDQKRATIQFHQPQRFKDELWRIQEKLECYFGSLVGSNVYITPAGSQGLPPHYDDVEVFILQLEGEKHWRLYHPTVPLAREYSVEAEERIGRPVHEFMLKPGDLLYFPRGTIHQADTPAGLAHSTHVTISTYQNNDAGARMRRCDLRAIAPQK

SEQ ID NO: 53806 - protein, 235 aa, Homo sapiens
  Payload ID: 10659
  Gene Symbol: MYCT1
  Gene Name: myc target 1
  Uniprot ID: Q8N699
  ENSP ID: ENSP00000356214
MRTQVYEGLCKNYFSLAVLQRDRIKLLFFDILVFLSVFLLFLLFLVDIMANNTTSLGSPWPENFWEDLIMSFTVSMAIGLVLGGFIWAVFICLSRRRRASAPISQWSSSRRSRSSYTHGLNRTGFYRHSGCERRSNLSLASLTFQRQASLEQANSFPRKSSFRASTFHPFLQCPPLPVETESQLVTLPSSNISPTISTSHSLSRPDYWSSNSLRVGLSTPPPPAYESIIKAFPDS

SEQ ID NO: 53807 - protein, 67 aa, Homo sapiens
  Payload ID: 10659
  Gene Symbol: MYCT1
  Gene Name: myc target 1
  ENSP ID: ENSP00000432612
MRTQVYEGLCKNYFSLAVLQRDRIKLLFFDILVFLSVFLLFLLFLVDIMANNTTSLGSPWPENFWGS

SEQ ID NO: 53808 - protein, 216 aa, Homo sapiens
  Payload ID: 10659
  Gene Symbol: MYCT1
  Gene Name: myc target 1
  ENSP ID: ENSP00000434396
  MOD_RES (1)..(1): Any amino acid
XRDRIKLLFFDILVFLSVFLLFLLFLVDIMANNTTSLGSPWPENFWEDLIMSFTVSMAIGLVLGGFIWAVFICLSRRRRASAPISQWSSSRRSRSSYTHGLNRTGFYRHSGCERRSNLSLASLTFQRQASLEQANSFPRKSSFRASTFHPFLQCPPLPVETESQLVTLPSSNISPTISTSHSLSRPDYWSSNSLRVGLSTPPPPAYESIIKAFPDS

SEQ ID NO: 53809 - protein, 493 aa, Homo sapiens
  Payload ID: 10660
  Gene Symbol: MAZ
  Gene Name: MYC-associated zinc finger protein (purine-binding transcription factor)
  Uniprot ID: P56270
  ENSP ID: ENSP00000219782
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGFTTAAYLRIHAVKDHGLQAPRADRILCKLCSVHCKTPAQLAGHMQTHLGGAAPPVPGDAPQPQPTC

SEQ ID NO: 53810 - protein, 477 aa, Homo sapiens
  Payload ID: 10660
  Gene Symbol: MAZ
  Gene Name: MYC-associated zinc finger protein (purine-binding transcription factor)
  Uniprot ID: P56270
  ENSP ID: ENSP00000313362
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 53811 - protein, 454 aa, Homo sapiens
  Payload ID: 10660
  Gene Symbol: MAZ
  Gene Name: MYC-associated zinc finger protein (purine-binding transcription factor)
  Uniprot ID: P56270
  ENSP ID: ENSP00000443956
MDPSNWSSFIFQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 53812 - protein, 78 aa, Homo sapiens
  Payload ID: 10660
  Gene Symbol: MAZ
  Gene Name: MYC-associated zinc finger protein (purine-binding transcription factor)
  ENSP ID: ENSP00000455473
MLSSAYISDHMKVHSQGPHHVCELCNKGTGEVCPMAAAAAAAAAAAAAAVAAPPTAVGSLSGAEGVPVSSQPLPSQPW

SEQ ID NO: 53813 - protein, 172 aa, Homo sapiens
  Payload ID: 10660
  Gene Symbol: MAZ
  Gene Name: MYC-associated zinc finger protein (purine-binding transcription factor)
  Uniprot ID: P56270
  ENSP ID: ENSP00000455726
MFPVFPCTLLAPPFPVLGLDSRGVGGLMNSFPPPQGHAQNPLQVGAELQSRFFASQGCAQSPFQKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 53814 - protein, 196 aa, Homo sapiens
  Payload ID: 10660
  Gene Symbol: MAZ
  Gene Name: MYC-associated zinc finger protein (purine-binding transcription factor)
  ENSP ID: ENSP00000455794
  MOD_RES (1)..(1): Any amino acid
XGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPCSSPGLVFSSLFPTTEEVVALAMSSCSCVPCMYPTLHPFLLRGPHYNKF

SEQ ID NO: 53815 - protein, 152 aa, Homo sapiens
  Payload ID: 10660
  Gene Symbol: MAZ
  Gene Name: MYC-associated zinc finger protein (purine-binding transcription factor)
  ENSP ID: ENSP00000455913
SFSRCARGLGRPLGRGEGGTRRRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 53816 - protein, 84 aa, Homo sapiens
  Payload ID: 10660
  Gene Symbol: MAZ
  Gene Name: MYC-associated zinc finger protein (purine-binding transcription factor)
  ENSP ID: ENSP00000456179
MFPVFPCTLLAPPFPVLGLDSRGVGGLMNSFPPPQGHAQNPLQVGAELQSRFFASQGCAQSPFQAGSPQQSRQTSALNRTALQM

SEQ ID NO: 53817 - protein, 186 aa, Homo sapiens
  Payload ID: 10660
  Gene Symbol: MAZ
  Gene Name: MYC-associated zinc finger protein (purine-binding transcription factor)
  ENSP ID: ENSP00000457310
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQDGSGGSGSSGSSSSPSHSCGLPLGGGGGACELSATSLPTLVSSKLVAGERGEWSRVPWYKLLSPLFSHQLLFPYQPRSLQKERRKKCFLRGIR

SEQ ID NO: 53818 - protein, 94 aa, Homo sapiens
  Payload ID: 10660
  Gene Symbol: MAZ
  Gene Name: MYC-associated zinc finger protein (purine-binding transcription factor)
  ENSP ID: ENSP00000458201
MLSSAYISDHMKVHSQGPHHVCELCNKGFTTAAYLRIHAVKDHGLQAPRADRILCKLCSVHCKTPAQLAGHMQTHLGGAAPPVPGDAPQPQPTC

SEQ ID NO: 53819 - protein, 202 aa, Homo sapiens
  Payload ID: 10660
  Gene Symbol: MAZ
  Gene Name: MYC-associated zinc finger protein (purine-binding transcription factor)
  ENSP ID: ENSP00000460057
AGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTCRGLPGGPGAEGGRLARRLATDTG

SEQ ID NO: 53820 - protein, 53 aa, Homo sapiens
  Payload ID: 10660
  Gene Symbol: MAZ
  Gene Name: MYC-associated zinc finger protein (purine-binding transcription factor)
  ENSP ID: ENSP00000460877
MLSSAYISDHMKVHSQGPHHVCELCNKGTCRGLPGGPGAEGGRLARRLATDTG

SEQ ID NO: 53821 - protein, 184 aa, Homo sapiens
  Payload ID: 10660
  Gene Symbol: MAZ
  Gene Name: MYC-associated zinc finger protein (purine-binding transcription factor)
  ENSP ID: ENSP00000461174
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQDGGSGSSGSSSSPSHSCGLPLGGGGGACELSATSLPTLVSSKLVAGERGEWSRVPWYKLLSPLFSHQLLFPYQPRSLQKERRKKCFLRGIR

SEQ ID NO: 53822 - protein, 78 aa, Homo sapiens
  Payload ID: 10660
  Gene Symbol: MAZ
  Gene Name: MYC-associated zinc finger protein (purine-binding transcription factor)
  ENSP ID: ENSP00000461630
MLSSAYISDHMKVHSQGPHHVCELCNKGFTTAAYLRIHAVKDHGLQAPRADRILCKLCSVHCKTPAQLAGHMQTHLGG

SEQ ID NO: 53823 - protein, 252 aa, Homo sapiens [sequence omitted]

SEQ ID NO: 53824 - protein, 984 aa, Homo sapiens
  Payload ID: 10661
  Gene Symbol: MYCBPAP
  Gene Name: MYCBP associated protein
  Uniprot ID: Q8TBZ2
  ENSP ID: ENSP00000323184
MRAPARGTGCCGRSGGRWLAGAAQPRCLWAGGAGQRFMVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRKSWENSGFWSRLEYLGDEMTGLVMTKTKTQRGLMEPITHIRKPHSIRVETGLPAQRDASYRYTWDRSLFLIYRRKELQRIMEELDFSQQDIDGLEVVGKGWPFSAVTVEDYTVFERSQGSSSEDTAYLGTLASSSDVSMPILGPSLLFCGKPACWIRGSNPQDKRQVGIAAHLTFETLEGEKTSSELTVVNNGTVAIWYDWRRQHQPDTFQDLKKNRMQRFYFDNREGVILPGEIKTFTFFFKSLTAGVFREFWEFRTHPTLLGGAILQVNLHAVSLTQDVFEDERKVLESKLTAHEAVTVVREVLQELLMGVLTPERTPSPVDAYLTEEDLFRHRNPPLHYEHQVVQSLHQLWRQYMTLPAKAEEARPGDKEHVSPIATEKASVNAELLPRFRSPISETQVPRPENEALRESGSQKARVGTKSPQRKSIMEEILVEESPDVDSTKSPWEPDGLPLLEWNLCLEDFRKAVMVLPDENHREDALMRLNKAALELCQKPRPLQSNLLHQMCLQLWRDVIDSLVGHSMWLRSVLGLPEKETIYLNVPEEQDQKSPPIMEVKVPVGKAGKEERKGAAQEKKQLGIKDKEDKKGAKLLGKEDRPNSKKHKAKDDKKVIKSASQDRFSLEDPTPDIILSSQEPIDPLVMGKYTQSLHSEVRGLLDTLVTDLMVLADELSPIKNVEEALRLCR

SEQ ID NO: 53825 - protein, 942 aa, Homo sapiens
  Payload ID: 10661
  Gene Symbol: MYCBPAP
  Gene Name: MYCBP associated protein
  Uniprot ID: Q8TBZ2
  ENSP ID: ENSP00000397209
MVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRKSWENSGFWSRLEYLGDEMTGLVMTKTKTQRGLMEPITHIRKPHSIRVETGLPAQRDASYRYTWDRSLFLIYRRKELQRIMEELDFSQQDIDGLEVVGKGWPFSAVTVEDYTVFERSQGSSSEDTAYLGTLASSSDVSMPILGPSLLFCGKPACWIRGSNPQDKRQVGIAAHLTFETLEGEKTSSELTVVNNGTVAIWYDWRRQHQPDTFQDLKKNRMQRFYFDNREGVILPGEIKTFTFFFKSLTAGVFREFWEFRTHPTLLGGAILQVNLHAVSLTQDVFEDERKVLESKLTAHEAVTVVREVLQELLMGVLTPERTPSPVDAYLTEEDLFRHRNPPLHYEHQVVQSLHQLWRQYMTLPAKAEEARPGDKEHVSPIATEKASVNAELLPRFRSPISETQVPRPENEALRESGSQKARVGTKSPQRKSIMEEILVEESPDVDSTKSPWEPDGLPLLEWNLCLEDFRKAVMVLPDENHREDALMRLNKAALELCQKPRPLQSNLLHQMCLQLWRDVIDSLVGHSMWLRSVLGLPEKETIYLNVPEEQDQKSPPIMEVKVPVGKAGKEERKGAAQEKKQLGIKDKEDKKGAKLLGKEDRPNSKKHKAKDDKKVIKSASQDRFSLEDPTPDIILSSQEPIDPLVMGKYTQSLHSEVHPGRCVPWENTMQGAFPSTTRCGGSCL

SEQ ID NO: 53826 - protein, 97 aa, Homo sapiens
  Payload ID: 10661
  Gene Symbol: MYCBPAP
  Gene Name: MYCBP associated protein
  ENSP ID: ENSP00000397686
  MOD_RES (1)..(1): Any amino acid
XRPLAGGCGAASVSLGRRCRATFHGAGRHHEVSKEGFPPQNNSDQIIRGLRECQRAQTGLELLGSSDLPALASQDLATLNPFLGMPLPMGKEAGKGT

SEQ ID NO: 53827 - protein, 314 aa, Homo sapiens
  Payload ID: 10661
  Gene Symbol: MYCBPAP
  Gene Name: MYCBP associated protein
  ENSP ID: ENSP00000407145
MRAPARGTGCCGRSGGRWLAGAAQPRCLWAGGAGQRFMVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGTPSLSPGFTVFQLMGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRK

SEQ ID NO: 53828 - protein, 89 aa, Homo sapiens
  Payload ID: 10661
  Gene Symbol: MYCBPAP
  Gene Name: MYCBP associated protein
  ENSP ID: ENSP00000407719
MRAPARGTGCCGRSGGRWLAGAAQPRCLWAGGAGQRFMVPGGTMKSLKKDSRLRITPTRLLEASENVKGWHAGGRIPGLDEVQKSQERV

SEQ ID NO: 53829 - protein, 954 aa, Homo sapiens
  Payload ID: 10661
  Gene Symbol: MYCBPAP
  Gene Name: MYCBP associated protein
  ENSP ID: ENSP00000414583
  MOD_RES (1)..(1): Any amino acid
XCLWAGGAGQRFMVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRKSWENSGFWSRLEYLGDEMTGLVMTKTKTQRGLMEPITHIRKPHSIRVETGLPAQRDASYRYTWDRSLFLIYRRKELQRIMEELDFSQQDIDGLEVVGKGWPFSAVTVEDYTVFERSQGSSSEDTAYLGTLASSSDVSMPILGPSLLFCGKPACWIRGSNPQDKRQVGIAAHLTFETLEGEKTSSELTVVNNGTVAIWYDWRRQHQPDTFQDLKKNRMQRFYFDNREGVILPGEIKTFTFFFKSLTAGVFREFWEFRTHPTLLGGAILQVNLHAVSLTQDVFEDERKVLESKLTAHEAVTVVREVLQELLMGVLTPERTPSPVDAYLTEEDLFRHRNPPLHYEHQVVQSLHQLWRQYMTLPAKAEEARPGDKEHVSPIATEKASVNAELLPRFRSPISETQVPRPENEALRESGSQKARVGTKSPQRKSIMEEILVEESPDVDSTKSPWEPDGLPLLEWNLCLEDFRKAVMVLPDENHREDALMRLNKAALELCQKPRPLQSNLLHQMCLQLWRDVIDSLVGHSMWLRSVLGLPEKETIYLNVPEEQDQKSPPIMEVKVPVGKAGKEERKGAAQEKKQLGIKDKEDKKGAKLLGKEDRPNSKKHKAKDDKKVIKSASQDRFSLEDPTPDIILSSQEPIDPLVMGKYTQSLHSEVHPGRCVPWENTMQGAFPSTTRCGGSCL

SEQ ID NO: 53830 - protein, 106 aa, Homo sapiens
  Payload ID: 10661
  Gene Symbol: MYCBPAP
  Gene Name: MYCBP associated protein
  ENSP ID: ENSP00000464992
  MOD_RES (1)..(1): Any amino acid
XVNLHAVSLTQDVFEDERKVLESKLTAHEAVTVVREVLQELLMGVLTPERTPSPVDAYLTEEDLFRHRNPPVRPSASPCPLMCALRQGSPTRRPHSGRSVGCWTPW

SEQ ID NO: 53831 - protein, 48 aa, Homo sapiens
  Payload ID: 10661
  Gene Symbol: MYCBPAP
  Gene Name: MYCBP associated protein
  ENSP ID: ENSP00000465337
  MOD_RES (1)..(1): Any amino acid
XHSEVKGSAQQPFPCLPPALFIPFSLQTISAHSIMVEAELLQEGHPRV

SEQ ID NO: 53832 - protein, 108 aa, Homo sapiens
  Payload ID: 10661
  Gene Symbol: MYCBPAP
  Gene Name: MYCBP associated protein
  ENSP ID: ENSP00000465746
  MOD_RES (1)..(1): Any amino acid
XDKEHVSPIATEKASVNAELLPRFRSPISETQVPRPENEALRESGSQKARVGTKSPQRKSIMEEILVEESPDVDSTKSPWEPDGLPLLEWNLCLEDFRKNGAHDPARQ

SEQ ID NO: 53833 - protein, 767 aa, Homo sapiens
  Payload ID: 10662
  Gene Symbol: MAATS1
  Gene Name: MYCBP-associated, testis expressed 1
  Uniprot ID: Q7Z4T9
  ENSP ID: ENSP00000273390
MSHAVTIEEPQAQPQVSQTRYRERSRAGSHISSNRAYDFLYDPLFIVSSEKDHTQANIQATLIRSRLRKVPRFKTMFSNLIHYPRYSLYWSKSDPVPPFISREWKGHKEKHREALRQLTTTDASFQMPKEVYEDPEVTGKNRYKYFERPFLPFFQQMPFNVVYAVSKAEPYTFPPTSTKHLSIPSKSTVGTQTDYRDADVQTDPYSAEYVVCQDSIPELLTLATLTWGRGLPAGQAEVEMIERAREKRAWEASLPALSDTSQFEKRRKMMNEMERKEWAFREQEIEKLQEIRLEVLKELLRKREENQNEVNMKHLNARWSKLQEGKEAKMAKIQRTHVSTIRKLVGKRKNIEGKLERRNIIKDYSDYASQVYGPLSRLGCFPDNNSEDFVVKNYYLNTYEGLVELESCLPDFVTQPQIRAPKPKVITTKAGFLKRAARLDYELAEVHKALLDKKNKVLEVKKPPRFLQRNPIPQPRLPTPTLEMTSNEEEEMEMAVIYLQKLLRGRVVQNMMFEGKEKRLELIQELRTCHALQEDEKLVKKAEKQVTLALQRQRNLHEHKVSLVENHLAGLEGRALADMFDFLSKELVRLQEERRIHAFVMLAERQRRVREAEESGRRQVEKQRLREEDEIFKEVVKVHHSTISSYLEDIILNTEANTAEEQARAEIEKMAEKINDIAYEMESRRTYLQSEEIVAELVYSFLIPEVQKYFVKEKVRNAQRKHILAAHQIIHSYTESMVQKKLTEGEQDEASNAAMLLEKETQNENNS

SEQ ID NO: 53834 - protein, 55 aa, Homo sapiens
  Payload ID: 10662
  Gene Symbol: MAATS1
  Gene Name: MYCBP-associated, testis expressed 1
  ENSP ID: ENSP00000418601
MSHAVTIEEPQAQPQVSQTRYRERSRAGSHISSNRAYDFLYGKDRRRPSSASVAS

SEQ ID NO: 53835 - protein, 238 aa, Homo sapiens
  Payload ID: 10662
  Gene Symbol: MAATS1
  Gene Name: MYCBP-associated, testis expressed 1
  Uniprot ID: Q7Z4T9
  ENSP ID: ENSP00000419489
MSHAVTIEEPQAQPQVSQTRYRERSRAGSHISSNRAYDFLYDPLFIVSSEKDHTQANIQATLIRSRLRKVPRFKTMFSNLIHYPRYSLYWSKSDPVPPFISREWKGHKEKHREALRQLTTTDASFQMPKEVYEDPEVTGKNRYKYFERPFLPFFQQMPFNVVYAVSKAEPYTFPPTSTKHLSIPSKSTVGTQTDYRDADVQTDPYSAEYVVCQDSIPELLTLATLTWGELVNLLTIGR

SEQ ID NO: 53836 - protein, 47 aa, Homo sapiens
  Payload ID: 10662
  Gene Symbol: MAATS1
  Gene Name: MYCBP-associated, testis expressed 1
  ENSP ID: ENSP00000419520
MSHAVTIEEPQAQPQVSQTRYRERSRAGSHISSNRAYDFLYEKSSQV

SEQ ID NO: 53837 - protein, 101 aa, Homo sapiens
  Payload ID: 10662
  Gene Symbol: MAATS1
  Gene Name: MYCBP-associated, testis expressed 1
  ENSP ID: ENSP00000419554
EWKGHKEKHREALRQLTTCLKKFMKILKLLERIAINTLKGLFSHFFSRCHSMLFMPYPRQNHTLFLLLLLSTYPSLQSLLWALRLIIGMLTFKQIHTLQNM

SEQ ID NO: 53838 - protein, 131 aa, Homo sapiens
  Payload ID: 10662
  Gene Symbol: MAATS1
  Gene Name: MYCBP-associated, testis expressed 1
  ENSP ID: ENSP00000419972
MSHAVTIEEPQAQPQVSQTRYRERSRAGSHISSNRAYDFLYELTLLFRCLKKFMKILKLLERIAINTLKGLFSHFFSRCHSMLFMPYPRQNHTLFLLLLLSTYPSLQSLLWALRLIIGMLTFKQIHTLQNM

SEQ ID NO: 53839 - protein, 582 aa, Homo sapiens
  Payload ID: 10663
  Gene Symbol: MAG
  Gene Name: myelin associated glycoprotein
  Uniprot ID: P20916
  ENSP ID: ENSP00000355234
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESKEVSTLESH

SEQ ID NO: 53840 - protein, 626 aa, Homo sapiens
  Payload ID: 10663
  Gene Symbol: MAG
  Gene Name: myelin associated glycoprotein
  Uniprot ID: P20916
  ENSP ID: ENSP00000376048
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 53841 - protein, 601 aa, Homo sapiens
  Payload ID: 10663
  Gene Symbol: MAG
  Gene Name: myelin associated glycoprotein
  Uniprot ID: P20916
  ENSP ID: ENSP00000440695
MPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 53842 - protein, 131 aa, Homo sapiens
  Payload ID: 10663
  Gene Symbol: MAG
  Gene Name: myelin associated glycoprotein
  ENSP ID: ENSP00000470772
MPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVE

SEQ ID NO: 53843 - protein, 158 aa, Homo sapiens
  Payload ID: 10663
  Gene Symbol: MAG
  Gene Name: myelin associated glycoprotein
  ENSP ID: ENSP00000473125
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVS

SEQ ID NO: 53844 - protein, 58 aa, Homo sapiens
  Payload ID: 10663
  Gene Symbol: MAG
  Gene Name: myelin associated glycoprotein
  ENSP ID: ENSP00000473245
MIFLTALPLFWIMISASRGGHWGAWMPSSISAFEGTCVSIPCRFDFPDELRPAVVHGV

SEQ ID NO: 53845 - protein, 73 aa, Homo sapiens
  Payload ID: 10664
  Gene Symbol: MBP
  Gene Name: myelin basic protein
  ENSP ID: ENSP00000346545
MASQKRPSQRHGSKYLATASTMDHARHGFLPRHRDTGILDSIGRFFGGDRGAPKRGSGKGGRDSRSGSPMARR

SEQ ID NO: 53846 - protein, 304 aa, Homo sapiens
  Payload ID: 10664
  Gene Symbol: MBP
  Gene Name: myelin basic protein
  Uniprot ID: P02686
  ENSP ID: ENSP00000348273
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 53847 - protein, 186 aa, Homo sapiens
  Payload ID: 10664
  Gene Symbol: MBP
  Gene Name: myelin basic protein
  Uniprot ID: P02686
  ENSP ID: ENSP00000352667
MASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGAEGQRPGFGYGGRASDYKSAHKGFKGVDAQGTLSKIFKLGGRDSRSGSPMARR

SEQ ID NO: 53848 - protein, 197 aa, Homo sapiens
  Payload ID: 10664
  Gene Symbol: MBP
  Gene Name: myelin basic protein
  Uniprot ID: P02686
  ENSP ID: ENSP00000372025
MASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 53849 - protein, 197 aa, Homo sapiens
  Payload ID: 10664
  Gene Symbol: MBP
  Gene Name: myelin basic protein
  Uniprot ID: P02686
  ENSP ID: ENSP00000380958
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKVSSEE

SEQ ID NO: 53850 - protein, 197 aa, Homo sapiens; identical to SEQ ID NO: 53849
  Payload ID: 10664
  Gene Symbol: MBP
  Gene Name: myelin basic protein
  Uniprot ID: P02686
  ENSP ID: ENSP00000380961

SEQ ID NO: 53851 - protein, 160 aa, Homo sapiens
  Payload ID: 10664
  Gene Symbol: MBP
  Gene Name: myelin basic protein
  Uniprot ID: P02686
  ENSP ID: ENSP00000380963
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGAEGQRPGFGYGGRASDYKSAHKGFKGVDAQGTLSKIFKLGGRDSRSGSPMARR

SEQ ID NO: 53852 - protein, 171 aa, Homo sapiens
  Payload ID: 10664
  Gene Symbol: MBP
  Gene Name: myelin basic protein
  Uniprot ID: P02686
  ENSP ID: ENSP00000380964
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 53853 - protein, 236 aa, Homo sapiens
  Payload ID: 10664
  Gene Symbol: MBP
  Gene Name: myelin basic protein
  ENSP ID: ENSP00000380967
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWVGDERTSIGFLFRPSPHSPATFVFCSVSVASWPPFLSSRDLSAHSWDRAALSSTGEMKRGLPFRKGAEGQRPGFGYGGRASDYKSAHKGFKGVDAQGTLSKIFKLGGRDSRSGSPMARR

SEQ ID NO: 53854 - protein, 181 aa, Homo sapiens
  Payload ID: 10664
  Gene Symbol: MBP
  Gene Name: myelin basic protein
  ENSP ID: ENSP00000380973
MASQKRPSQRHGSKYLATASTMDHARHGFLPRHRDTGILDSIGRFFGGDRGAPKRGSGKDSHHPARTAHYGSLPQKSHGRTQDENPVVHFFKNICSPRFSVSFQVTPRTPPPSQGKGRGLSLSRFSWGAEGQRPGFGYGGRASDYKSAHKGFKGVDAQGTLSKIFKLGGRDSRSGSPMARR

SEQ ID NO: 53855 - protein, 101 aa, Homo sapiens
  Payload ID: 10664
  Gene Symbol: MBP
  Gene Name: myelin basic protein
  ENSP ID: ENSP00000405882
MYKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKL

SEQ ID NO: 53856 - protein, 32 aa, Homo sapiens
  Payload ID: 10664
  Gene Symbol: MBP
  Gene Name: myelin basic protein
  ENSP ID: ENSP00000431267
MASQKRPSQRHGSKYLATASTMDHARHGFLPR

SEQ ID NO: 53857 - protein, 59 aa, Homo sapiens
  Payload ID: 10664
  Gene Symbol: MBP
  Gene Name: myelin basic protein
  ENSP ID: ENSP00000431335
MASQKRPSQRHGSKYLATASTMDHARHGFLPRTHTTRQELLTTAPCPRSHTAGPKMKTP

SEQ ID NO: 53858 - protein, 98 aa, Homo sapiens
  Payload ID: 10664
  Gene Symbol: MBP
  Gene Name: myelin basic protein
  ENSP ID: ENSP00000432988
MASQKRPSQRHGSKYLATASTMDHARHGFLPRHRDTGILDSIGRFFGGDRGAPKRGSGKDSHHPARTAHYGSLPQKSHGRTQDENPVVHFFKNIAGAR

SEQ ID NO: 53859 - protein, 64 aa, Homo sapiens
  Payload ID: 10664
  Gene Symbol: MBP
  Gene Name: myelin basic protein
  ENSP ID: ENSP00000434011
MASQKRPSQRHGSKYLATASTMDHARHGFLPSGALARTHTTRQELLTTAPCPRSHTAGPKMKTP

SEQ ID NO: 53860 - protein, 108 aa, Homo sapiens
  Payload ID: 10664
  Gene Symbol: MBP
  Gene Name: myelin basic protein
  ENSP ID: ENSP00000435243
MASQKRPSQRHGSKYLATASTMDHARHGFLPRHRDTGILDSIGRFFGGDRGAPKRGSGKDSHHPARTAHYGSLPQKHTAAETERTWAAERTVDIQASFVFFSCPSLTS

SEQ ID NO: 53861 - protein, 119 aa, Homo sapiens
  Payload ID: 10664
  Gene Symbol: MBP
  Gene Name: myelin basic protein
  ENSP ID: ENSP00000435322
MASQKRPSQRHGSKYLATASTMDHARHGFLPRHRDTGILDSIGRFFGGDRGAPKRGSGKDSHHPARTAHYGSLPQKSHGRTQDENPVVHFFKNIVYTSSPTRTEVGRLGTRVLLAADGC

SEQ ID NO: 53862 - protein, 149 aa, Homo sapiens
  Payload ID: 10664
  Gene Symbol: MBP
  Gene Name: myelin basic protein
  ENSP ID: ENSP00000435641
MASQKRPSQRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 53863 - protein, 68 aa, Homo sapiens
  Payload ID: 10664
  Gene Symbol: MBP
  Gene Name: myelin basic protein
  ENSP ID: ENSP00000436830
MASQKRPSQRHGSKYLATASTMDHARHGFLPRARFPKFLSWEEEIVALDHPWLDAENPPGSGILSSAS

SEQ ID NO: 53864 - protein, 108 aa, Homo sapiens
  Payload ID: 10664
  Gene Symbol: MBP
  Gene Name: myelin basic protein
  ENSP ID: ENSP00000436951
MASQKRPSQRHGSKYLATASTMDHARHGFLPRHRDTGILDSIGRFFGGDRGAPKRGSGKDSHHPARTAHYGSLPQKSHGRTQDENPVVHFFKNIDRSGEAGHPGASGS

SEQ ID NO: 53865 - protein, 86 aa, Homo sapiens
  Payload ID: 10664
  Gene Symbol: MBP
  Gene Name: myelin basic protein
  ENSP ID: ENSP00000437063
MASQKRPSQRHGSKYLATASTMDHARHGFLPRHRDTGILDSIGRFFGGDRGAPKRGSGKDSHHPARTAHYGSLPQKSHGRTQDENP

SEQ ID NO: 53866 - protein, 66 aa, Homo sapiens
  Payload ID: 10664
  Gene Symbol: MBP
  Gene Name: myelin basic protein
  ENSP ID: ENSP00000442393
MASQKRPSQRHGSKYLATASTMDHARHGFLPRHRDTGILDSIGRFFGGDRGAPKRGSGKESRTLSR

SEQ ID NO: 53867 - protein, 304 aa, Homo sapiens; identical to SEQ ID NO: 53846
  Payload ID: 10664
  Gene Symbol: MBP
  Gene Name: myelin basic protein
  Uniprot ID: P02686
  ENSP ID: ENSP00000462223

SEQ ID NO: 53868 - protein, 159 aa, Homo sapiens
  Payload ID: 10664
  Gene Symbol: MBP
  Gene Name: myelin basic protein
  ENSP ID: ENSP00000462374
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHAR

SEQ ID NO: 53869 - protein, 180 aa, Homo sapiens
  Payload ID: 10664
  Gene Symbol: MBP
  Gene Name: myelin basic protein
  ENSP ID: ENSP00000462734
  MOD_RES (1)..(1): Any amino acid
XLPQKSHGRTQDENPVVHFFKNIVTPRTPPPSQGKGRGLSLSRFSWVGDERTSIGFLFRPSPHSPATFVFCSVSVASWPPFLSSRDLSAHSWDRAALSSTGEMKRGLPFRKVWSLASVPGTQPCKARSSSPRGFPGDVTGLPPREGATPRPRKCLTSSNTTSARSPRNPHVEVGLAGPSQ

SEQ ID NO: 53870 - protein, 59 aa, Homo sapiens; identical to SEQ ID NO: 53857
  Payload ID: 10664
  Gene Symbol: MBP
  Gene Name: myelin basic protein
  ENSP ID: ENSP00000462758

SEQ ID NO: 53871 - protein, 60 aa, Homo sapiens
  Payload ID: 10664
  Gene Symbol: MBP
  Gene Name: myelin basic protein
  ENSP ID: ENSP00000462780
  MOD_RES (1)..(1): Any amino acid
XQKRPSQRHGSKYLATASTMDHARHGFLPRHRDTGILDSIGRFFGGDRGAPKRGSGKDCP

SEQ ID NO: 53872 - protein, 171 aa, Homo sapiens
  Payload ID: 10664
  Gene Symbol: MBP
  Gene Name: myelin basic protein
  ENSP ID: ENSP00000463137
MASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGRGLSLSRFSWVGDERTSIGFLFRPSPHSPATFVFCSVS

SEQ ID NO: 53873 - protein, 41 aa, Homo sapiens
  Payload ID: 10664
  Gene Symbol: MBP
  Gene Name: myelin basic protein
  ENSP ID: ENSP00000463164
MGNHAGKRELNAEKASTNSETNRGESEKKRNLGELSRTTSE

SEQ ID NO: 53874 - protein, 157 aa, Homo sapiens
  Payload ID: 10664
  Gene Symbol: MBP
  Gene Name: myelin basic protein
  ENSP ID: ENSP00000463403
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKL

SEQ ID NO: 53875 - protein, 253 aa, Homo sapiens
  Payload ID: 10664
  Gene Symbol: MBP
  Gene Name: myelin basic protein
  ENSP ID: ENSP00000463780
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGGRDSRSGSPMARR

SEQ ID NO: 53876 - protein, 576 aa, Homo sapiens
  Payload ID: 10665
  Gene Symbol: MYEF2
  Gene Name: myelin expression factor 2
  ENSP ID: ENSP00000267836
MADANKAEVPGATGGDSPHLQPAEPPGEPRREPHPAEAEKQQPQHSSSSNGVKMENDESAKEEKSDLKEKSTGSKKANRFHPYSKDKNSGAGEKKGPNRNRVFISNIPYDMKWQAIKDLMREKVGEVTYVELFKDAEGKSRGCGVVEFKDEEFVKKALETMNKYDLSGRPLNIKEDPDGENARRALQRTGGSFPGGHVPDMGSGLMNLPPSILNNPNIPPEVISNLQAGRLGSTIFVANLDFKVGWKKLKEVFSIAGTVKRADIKEDKDGKSRGMGTVTFEQAIEAVQAISMFNGQFLFDRPMHVKMDDKSVPHEEYRSHDGKTPQLPRGLGGIGMGLGPGGQPISASQLNIGGVMGNLGPGGMGMDGPGFGGMNRIGGGIGFGGLEAMNSMGGFGGVGRMGELYRGAMTSSMERDFGRGDIGINRGFGDSFGRLGGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 53877 - protein, 600 aa, Homo sapiens
  Payload ID: 10665
  Gene Symbol: MYEF2
  Gene Name: myelin expression factor 2
  ENSP ID: ENSP00000316950
MADANKAEVPGATGGDSPHLQPAEPPGEPRREPHPAEAEKQQPQHSSSSNGVKMENDESAKEEKSDLKEKSTGSKKANRFHPYSKDKNSGAGEKKGPNRNRVFISNIPYDMKWQAIKDLMREKVGEVTYVELFKDAEGKSRGCGVVEFKDEEFVKKALETMNKYDLSGRPLNIKEDPDGENARRALQRTGGSFPGGHVPDMGSGLMNLPPSILNNPNIPPEVISNLQAGRLGSTIFVANLDFKVGWKKLKEVFSIAGTVKRADIKEDKDGKSRGMGTVTFEQAIEAVQAISMFNGQFLFDRPMHVKMDDKSVPHEEYRSHDGKTPQLPRGLGGIGMGLGPGGQPISASQLNIGGVMGNLGPGGMGMDGPGFGGMNRIGGGIGFGGLEAMNSMGGFGGVGRMGELYRGAMTSSMERDFGRGDIGINRGFGDSFGRLGSAMIGGFAGRIGSSNMGPVGSGISGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 53878 - protein, 128 aa, Homo sapiens
  Payload ID: 10665
  Gene Symbol: MYEF2
  Gene Name: myelin expression factor 2
  Uniprot ID: Q9P2K5
  ENSP ID: ENSP00000452913
MADANKAEVPGATGGDSPHLQPAEPPGEPRREPHPAEAEKQQPQHSSSSNGVKMENDESAKEEKSDLKEKSTGSKKANRFHPYSKDKNSGAGEKKGPNRNRVFISNIPYDMKWQAIKDLMREKGLWCG

SEQ ID NO: 53879 - protein, 126 aa, Homo sapiens
  Payload ID: 10665
  Gene Symbol: MYEF2
  Gene Name: myelin expression factor 2
  ENSP ID: ENSP00000452918
  MOD_RES (1)..(1): Any amino acid
XGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 53880 - protein, 128 aa, Homo sapiens; identical to SEQ ID NO: 53878
  Payload ID: 10665
  Gene Symbol: MYEF2
  Gene Name: myelin expression factor 2
  Uniprot ID: Q9P2K5
  ENSP ID: ENSP00000453125

SEQ ID NO: 53881 - protein, 290 aa, Homo sapiens
  Payload ID: 10665
  Gene Symbol: MYEF2
  Gene Name: myelin expression factor 2
  ENSP ID: ENSP00000453830
  MOD_RES (1)..(1): Any amino acid
XEVISNLQAGRLGSTIFVANLDFKVGWKKLKEVFSIAGTVKRADIKEDKDGKSRGMGTVTFEQAIEAVQAISMFNGQFLFDRPMHVKMDDKSVPHEEYRSHDGKTPQLPRGLGGIGMGLGPGGQPISASQLNIGGVMGNLGPGGIGFGGLEAMNSMGGFGGVGRMGELYRGAMTSSMERDFGRGDIGINRGFGDSFGRLGGGMGSMNSVTGGMGMGLDRMSSSFDRMGPGIGAILERSIDMDRGFLSGPMGSGMRERIGSKGNQIFVRNLPFDLTWQKLKEKFSQCGHVM

SEQ ID NO: 53882 - protein, 547 aa, Homo sapiens
  Payload ID: 10665
  Gene Symbol: MYEF2
  Gene Name: myelin expression factor 2
  ENSP ID: ENSP00000478898
MENDESAKEEKSDLKEKSTGSKKANRFHPYSKDKNSGAGEKKGPNRNRVFISNIPYDMKWQAIKDLMREKVGEVTYVELFKDAEGKSRVSGVVEFKDEEFVKKALETMNKYDLSGRPLNIKEDPDGENARRALQRTGGSFPGGHVPDMGSGLMNLPPSILNNPNIPPEVISNLQAGRLGSTIFVANLDFKVGWKKLKEVFSIAGTVKRADIKEDKDGKSRGMGTVTFEQAIEAVQAISMFNGQFLFDRPMHVKMDDKSVPHEEYRSHDGKTPQLPRGLGGIGMGLGPGGQPISASQLNIGGVMGNLGPGGMGMDGPGFGGMNRIGGGIGFGGLEAMNSMGGFGGVGRMGELYRGAMTSSMERDFGRGDIGINRGFGDSFGRLGSAMIGGFAGRIGSSNMGPVGSGISGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 53883 - protein, 126 aa, Homo sapiens
  Payload ID: 10665
  Gene Symbol: MYEF2
  Gene Name: myelin expression factor 2
  ENSP ID: ENSP00000480118
MADANKAEVPGATGGDSPHLQPAEPPGEPRREPHPAEAEKQQPQHSSSSNGVKMENDESAKEEKSDLKEKSTGSKKANRFHPYSKDKNSGAGEKKGPNRNRVFISNIPYDMKWQAIKDLMREKGCG

SEQ ID NO: 53884 - protein, 211 aa, Homo sapiens
  Payload ID: 10665
  Gene Symbol: MYEF2
  Gene Name: myelin expression factor 2
  ENSP ID: ENSP00000480281
MDGPGFGGMNRIGGGIGFGGLEAMNSMGGFGGVGRMGELYRGAMTSSMERDFGRGDIGINRGFGDSFGRLGGGMGSMNSVTGGMGMGLDRMSSSFDRMGPGIGAILERSIDMDRGFLSGPMGSGMRERIGSKGNQIFVRNLPFDLTWQKLKEKFSQCGHVMFAEIKMENGKSKGCGTVRFDSPESAEKACRIMNGIKISGREIDVRLDRNA

SEQ ID NO: 53885 - protein, 295 aa, Homo sapiens [sequence omitted]

SEQ ID NO: 53886 - protein, 213 aa, Homo sapiens
  Payload ID: 10666
  Gene Symbol: MOG
  Gene Name: myelin oligodendrocyte glycoprotein
  Uniprot ID: Q16653
  ENSP ID: ENSP00000352534
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFGQFLEELLFHLEALSG

SEQ ID NO: 53887 - protein, 131 aa, Homo sapiens
  Payload ID: 10666
  Gene Symbol: MOG
  Gene Name: myelin oligodendrocyte glycoprotein
  Uniprot ID: Q16653
  ENSP ID: ENSP00000366085
MASLSRPSLPSCLCSFLLLLLLQVSSSYADPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELRNPF

SEQ ID NO: 53888 - protein, 142 aa, Homo sapiens
  Payload ID: 10666
  Gene Symbol: MOG
  Gene Name: myelin oligodendrocyte glycoprotein
  ENSP ID: ENSP00000366086
  MOD_RES (1)..(1): Any amino acid
XQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEVSHSVTQDWLQWHDHGSLQPPPPRLK

SEQ ID NO: 53889 - protein, 206 aa, Homo sapiens
  Payload ID: 10666
  Gene Symbol: MOG
  Gene Name: myelin oligodendrocyte glycoprotein
  Uniprot ID: Q16653
  ENSP ID: ENSP00000366088
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFVFHLEALSG

SEQ ID NO: 53890 - protein, 295 aa, Homo sapiens
  Payload ID: 10666
  Gene Symbol: MOG
  Gene Name: myelin oligodendrocyte glycoprotein
  Uniprot ID: Q16653
  ENSP ID: ENSP00000366091
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELRKFSSLCYKQRIKSQERETEATRGRGGLLRDHIPRGKEELESLGGGKTPPGR

SEQ ID NO: 53891 - protein, 252 aa, Homo sapiens
  Payload ID: 10666
  Gene Symbol: MOG
  Gene Name: myelin oligodendrocyte glycoprotein
  Uniprot ID: Q16653
  ENSP ID: ENSP00000366095
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELLFHLEALSG

SEQ ID NO: 53892 - protein, 45 aa, Homo sapiens
  Payload ID: 10666
  Gene Symbol: MOG
  Gene Name: myelin oligodendrocyte glycoprotein
  ENSP ID: ENSP00000366101
MASLSRPSLPSCLCSFLLLLLLQVSSSYAVQSDRTKTPYPGSGRG

SEQ ID NO: 53893 - protein, 247 aa, Homo sapiens
  Payload ID: 10666
  Gene Symbol: MOG
  Gene Name: myelin oligodendrocyte glycoprotein
  Uniprot ID: Q16653
  ENSP ID: ENSP00000366115
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELRNPF

SEQ ID NO: 53894 - protein, 131 aa, Homo sapiens [sequence omitted]

SEQ ID NO: 53895 - protein, 247 aa, Homo sapiens
  Payload ID: 10666
  Gene Symbol: MOG
  Gene Name: myelin oligodendrocyte glycoprotein
  Uniprot ID: Q16653
  ENSP ID: ENSP00000373017
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFDPHFLRVPCWKITLFVIVPVLGPLVALIICYNWLHRRLAGQFLEELRNPF

SEQ ID NO: 53896 - protein, 247 aa, Homo sapiens; identical to SEQ ID NO: 53895
  Payload ID: 10666
  Gene Symbol: MOG
  Gene Name: myelin oligodendrocyte glycoprotein
  Uniprot ID: Q16653
  ENSP ID: ENSP00000373126

SEQ ID NO: 53897 - protein, 229 aa, Homo sapiens [sequence omitted]

SEQ ID NO: 53898 - protein, 213 aa, Homo sapiens
  Payload ID: 10666
  Gene Symbol: MOG
  Gene Name: myelin oligodendrocyte glycoprotein
  Uniprot ID: Q16653
  ENSP ID: ENSP00000379929
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFGQFLEELLFHLEALSG

SEQ ID NO: 53899 - protein, 224 aa, Homo sapiens
  Payload ID: 10666
  Gene Symbol: MOG
  Gene Name: myelin oligodendrocyte glycoprotein
  Uniprot ID: Q16653
  ENSP ID: ENSP00000379932
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFESFGVLGPQVKEPKKTGQFLEELRNPF

SEQ ID NO: 53900 - protein, 224 aa, Homo sapiens
  Payload ID: 10666
  Gene Symbol: MOG
  Gene Name: myelin oligodendrocyte glycoprotein
  ENSP ID: ENSP00000383509
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFESFGVLGPQVKEPKKTGQFLEELRNPF

SEQ ID NO: 53901 - protein, 229 aa, Homo sapiens [sequence omitted]

SEQ ID NO: 53902 - protein, 213 aa, Homo sapiens; identical to SEQ ID NO: 53886
  Payload ID: 10666
  Gene Symbol: MOG
  Gene Name: myelin oligodendrocyte glycoprotein
  Uniprot ID: Q16653
  ENSP ID: ENSP00000383512

SEQ ID NO: 53903 - protein, 179 aa, Homo sapiens
  Payload ID: 10666
  Gene Symbol: MOG
  Gene Name: myelin oligodendrocyte glycoprotein
  ENSP ID: ENSP00000383525
  MOD_RES (1)..(1): Any amino acid
XQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFGQFLEELRNPF

SEQ ID NO: 53904 - protein, 131 aa, Homo sapiens [sequence omitted]

SEQ ID NO: 53905 - protein, 204 aa, Homo sapiens
  Payload ID: 10666
  Gene Symbol: MOG
  Gene Name: myelin oligodendrocyte glycoprotein
  Uniprot ID: Q16653
  ENSP ID: ENSP00000383528
SLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFVFHLEALSG

SEQ ID NO: 53906 - protein, 131 aa, Homo sapiens
  Payload ID: 10666
  Gene Symbol: MOG
  Gene Name: myelin oligodendrocyte glycoprotein
  ENSP ID: ENSP00000387448
MASLSRPSLPSCLCSFLLLLLLQVSSSYADPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELRNPF

SEQ ID NO: 53907 - protein, 247 aa, Homo sapiens
  Payload ID: 10666
  Gene Symbol: MOG
  Gene Name: myelin oligodendrocyte glycoprotein
  Uniprot ID: Q16653
  ENSP ID: ENSP00000389022
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELRNPF

SEQ ID NO: 53908 - protein, 247 aa, Homo sapiens; identical to SEQ ID NO: 53895
  Payload ID: 10666
  Gene Symbol: MOG
  Gene Name: myelin oligodendrocyte glycoprotein
  Uniprot ID: Q16653
  ENSP ID: ENSP00000389221

SEQ ID NO: 53909 - protein, 224 aa, Homo sapiens [sequence omitted]

SEQ ID NO: 53910 - protein, 295 aa, Homo sapiens [sequence omitted]

SEQ ID NO: 53911 - protein, 213 aa, Homo sapiens; identical to SEQ ID NO: 53886
  Payload ID: 10666
  Gene Symbol: MOG
  Gene Name: myelin oligodendrocyte glycoprotein
  Uniprot ID: Q16653
  ENSP ID: ENSP00000390682

SEQ ID NO: 53912 - protein, 295 aa, Homo sapiens
  Payload ID: 10666
  Gene Symbol: MOG
  Gene Name: myelin oligodendrocyte glycoprotein
  ENSP ID: ENSP00000390785
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELRKFSSLCYKQRIKSQERETEATRGRGGLLRDHIPRGKEELESLGGGKTPPGR

SEQ ID NO: 53913 - protein, 213 aa, Homo sapiens; identical to SEQ ID NO: 53886
  Payload ID: 10666
  Gene Symbol: MOG
  Gene Name: myelin oligodendrocyte glycoprotein
  Uniprot ID: Q16653
  ENSP ID: ENSP00000391516

SEQ ID NO: 53914 - protein, 295 aa, Homo sapiens [sequence omitted]

SEQ ID NO: 53915 - protein, 179 aa, Homo sapiens; identical to SEQ ID NO: 53903
  Payload ID: 10666
  Gene Symbol: MOG
  Gene Name: myelin oligodendrocyte glycoprotein
  ENSP ID: ENSP00000392661
  MOD_RES (1)..(1): Any amino acid

SEQ ID NO: 53916 - protein, 252 aa, Homo sapiens
  Payload ID: 10666
  Gene Symbol: MOG
  Gene Name: myelin oligodendrocyte glycoprotein
  ENSP ID: ENSP00000394156
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFDPHFLRVPCWKITLFVIVPVLGPLVALIICYNWLHRRLAGQFLEELLFHLEALSG

SEQ ID NO: 53917 - protein, 131 aa, Homo sapiens [sequence omitted]

SEQ ID NO: 53918 - protein, 295 aa, Homo sapiens [sequence omitted]

SEQ ID NO: 53919 - protein, 204 aa, Homo sapiens
  Payload ID: 10666
  Gene Symbol: MOG
  Gene Name: myelin oligodendrocyte glycoprotein
  ENSP ID: ENSP00000395146
SLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFVFHLEALSG

SEQ ID NO: 53920 - protein, 252 aa, Homo sapiens; identical to SEQ ID NO: 53916
  Payload ID: 10666
  Gene Symbol: MOG
  Gene Name: myelin oligodendrocyte glycoprotein
  ENSP ID: ENSP00000395304

SEQ ID NO: 53921 - protein, 252 aa, Homo sapiens; identical to SEQ ID NO: 53916
  Payload ID: 10666
  Gene Symbol: MOG
  Gene Name: myelin oligodendrocyte glycoprotein
  ENSP ID: ENSP00000396344

SEQ ID NO: 53922 - protein, 295 aa, Homo sapiens [sequence omitted]

SEQ ID NO: 53923 - protein, 204 aa, Homo sapiens; identical to SEQ ID NO: 53905
  Payload ID: 10666
  Gene Symbol: MOG
  Gene Name: myelin oligodendrocyte glycoprotein
  Uniprot ID: Q16653
  ENSP ID: ENSP00000397723

SEQ ID NO: 53924 - protein, 204 aa, Homo sapiens; identical to SEQ ID NO: 53905
  Payload ID: 10666
  Gene Symbol: MOG
  Gene Name: myelin oligodendrocyte glycoprotein
  Uniprot ID: Q16653
  ENSP ID: ENSP00000397837

SEQ ID NO: 53925 - protein, 213 aa, Homo sapiens; identical to SEQ ID NO: 53886
  Payload ID: 10666
  Gene Symbol: MOG
  Gene Name: myelin oligodendrocyte glycoprotein
  Uniprot ID: Q16653
  ENSP ID: ENSP00000398197

SEQ ID NO: 53926 - protein, 295 aa, Homo sapiens [sequence omitted]

SEQ ID NO: 53927 - protein, 204 aa, Homo sapiens; identical to SEQ ID NO: 53905
  Payload ID: 10666
  Gene Symbol: MOG
  Gene Name: myelin oligodendrocyte glycoprotein
  Uniprot ID: Q16653
  ENSP ID: ENSP00000399240

SEQ ID NO: 53928 - protein, 252 aa, Homo sapiens; identical to SEQ ID NO: 53916
  Payload ID: 10666
  Gene Symbol: MOG
  Gene Name: myelin oligodendrocyte glycoprotein
  ENSP ID: ENSP00000400564

SEQ ID NO: 53929 - protein, 252 aa, Homo sapiens
  Payload ID: 10666
  Gene Symbol: MOG
  Gene Name: myelin oligodendrocyte glycoprotein
  ENSP ID: ENSP00000400681
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELLFHLEALSG

SEQ ID NO: 53930 - protein, 179 aa, Homo sapiens; identical to SEQ ID NO: 53903
  Payload ID: 10666
  Gene Symbol: MOG
  Gene Name: myelin oligodendrocyte glycoprotein
  ENSP ID: ENSP00000401457
  MOD_RES (1)..(1): Any amino acid

SEQ ID NO: 53931 - protein, 247 aa, Homo sapiens; identical to SEQ ID NO: 53895
  Payload ID: 10666
  Gene Symbol: MOG
  Gene Name: myelin oligodendrocyte glycoprotein
  Uniprot ID: Q16653
  ENSP ID: ENSP00000401609

SEQ ID NO: 53932 - protein, 229 aa, Homo sapiens [sequence omitted]

SEQ ID NO: 53933 - protein, 213 aa, Homo sapiens
  Payload ID: 10666
  Gene Symbol: MOG
  Gene Name: myelin oligodendrocyte glycoprotein
  ENSP ID: ENSP00000402247
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFGQFLEELLFHLEALSG

SEQ ID NO: 53934 - protein, 252 aa, Homo sapiens; identical to SEQ ID NO: 53916
  Payload ID: 10666
  Gene Symbol: MOG
  Gene Name: myelin oligodendrocyte glycoprotein
  ENSP ID: ENSP00000402363

SEQ ID NO: 53935 - protein, 229 aa, Homo sapiens [sequence omitted]

SEQ ID NO: 53936 - protein, 179 aa, Homo sapiens; identical to SEQ ID NO: 53903
  Payload ID: 10666
  Gene Symbol: MOG
  Gene Name: myelin oligodendrocyte glycoprotein
  ENSP ID: ENSP00000403235
  MOD_RES (1)..(1): Any amino acid

SEQ ID NO: 53937 - protein, 224 aa, Homo sapiens [sequence omitted]

SEQ ID NO: 53938 - protein, 224 aa, Homo sapiens [sequence omitted]

SEQ ID NO: 53939 - protein, 224 aa, Homo sapiens [sequence omitted]

SEQ ID NO: 53940 - protein, 252 aa, Homo sapiens; identical to SEQ ID NO: 53916
  Payload ID: 10666
  Gene Symbol: MOG
  Gene Name: myelin oligodendrocyte glycoprotein
  ENSP ID: ENSP00000404362

SEQ ID NO: 53941 - protein, 247 aa, Homo sapiens; identical to SEQ ID NO: 53895
  Payload ID: 10666
  Gene Symbol: MOG
  Gene Name: myelin oligodendrocyte glycoprotein
  Uniprot ID: Q16653
  ENSP ID: ENSP00000404537

SEQ ID NO: 53942 - protein, 229 aa, Homo sapiens [sequence omitted]

SEQ ID NO: 53943 - protein, 179 aa, Homo sapiens
  Payload ID: 10666
  Gene Symbol: MOG
  Gene Name: myelin oligodendrocyte glycoprotein
  ENSP ID: ENSP00000406627
  MOD_RES (1)..(1): Any amino acid
XQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFGQFLEELRNPF

SEQ ID NO: 53944 - protein, 179 aa, Homo sapiens; identical to SEQ ID NO: 53903
  Payload ID: 10666
  Gene Symbol: MOG
  Gene Name: myelin oligodendrocyte glycoprotein
  ENSP ID: ENSP00000407143
  MOD_RES (1)..(1): Any amino acid

SEQ ID NO: 53945 - protein, 179 aa, Homo sapiens; identical to SEQ ID NO: 53903
  Payload ID: 10666
  Gene Symbol: MOG
  Gene Name: myelin oligodendrocyte glycoprotein
  ENSP ID: ENSP00000408039
  MOD_RES (1)..(1): Any amino acid

SEQ ID NO: 53946 - protein, 209 aa, Homo sapiens
  Payload ID: 10666
  Gene Symbol: MOG
  Gene Name: myelin oligodendrocyte glycoprotein
  ENSP ID: ENSP00000409394
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEGKLRAEIENLHRTFDPHFLRVPCWKITLFVIVPVLGPLVALIICYNWLHRRLAGQFLEELRNPF

SEQ ID NO: 53947 - protein, 213 aa, Homo sapiens; identical to SEQ ID NO: 53886
  Payload ID: 10666
  Gene Symbol: MOG
  Gene Name: myelin oligodendrocyte glycoprotein
  Uniprot ID: Q16653
  ENSP ID: ENSP00000409534

SEQ ID NO: 53948 - protein, 131 aa, Homo sapiens [sequence omitted]

SEQ ID NO: 53949 - protein, 131 aa, Homo sapiens [sequence omitted]

SEQ ID NO: 53950 - protein, 208 aa, Homo sapiens
  Payload ID: 10666
  Gene Symbol: MOG
  Gene Name: myelin oligodendrocyte glycoprotein
  Uniprot ID: Q16653
  ENSP ID: ENSP00000410866
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFGQFLEELRNPF

SEQ ID NO: 53951 - protein, 229 aa, Homo sapiens [sequence omitted]

SEQ ID NO: 53952 - protein, 131 aa, Homo sapiens [sequence omitted]

SEQ ID NO: 53953 - protein, 204 aa, Homo sapiens; identical to SEQ ID NO: 53905
  Payload ID: 10666
  Gene Symbol: MOG
  Gene Name: myelin oligodendrocyte glycoprotein
  Uniprot ID: Q16653
  ENSP ID: ENSP00000413370

SEQ ID NO: 53954 - protein, 224 aa, Homo sapiens [sequence omitted]

SEQ ID NO: 53955 - protein, 247 aa, Homo sapiens; identical to SEQ ID NO: 53895
  Payload ID: 10666
  Gene Symbol: MOG
  Gene Name: myelin oligodendrocyte glycoprotein
  Uniprot ID: Q16653
  ENSP ID: ENSP00000414489

SEQ ID NO: 53956 - protein, 224 aa, Homo sapiens [sequence omitted]

SEQ ID NO: 53957 - protein, 204 aa, Homo sapiens; identical to SEQ ID NO: 53905
  Payload ID: 10666
  Gene Symbol: MOG
  Gene Name: myelin oligodendrocyte glycoprotein
  Uniprot ID: Q16653
  ENSP ID: ENSP00000415883

SEQ ID NO: 53958 - protein, 229 aa, Homo sapiens
  Payload ID: 10666
  Gene Symbol: MOG
  Gene Name: myelin oligodendrocyte glycoprotein
  Uniprot ID: Q16653
  ENSP ID: ENSP00000417405
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFESFGVLGPQVKEPKKTGQFLEELLFHLEALSG

SEQ ID NO: 53959 - protein, 92 aa, Homo sapiens
  Payload ID: 10666
  Gene Symbol: MOG
  Gene Name: myelin oligodendrocyte glycoprotein
  ENSP ID: ENSP00000418090
MASLSRPSLPSCLCSFLLLLLLQVSSSYADPFYWVSPGVLVLLAVLPVLLLQITVGLIFLCLQYRLRGKLRAEIENLHRTFGQFLEELRNPF

SEQ ID NO: 53960 - protein, 142 aa, Homo sapiens; identical to SEQ ID NO: 53888
  Payload ID: 10666
  Gene Symbol: MOG
  Gene Name: myelin oligodendrocyte glycoprotein
  ENSP ID: ENSP00000418872
  MOD_RES (1)..(1): Any amino acid

SEQ ID NO: 53961 - protein, 229 aa, Homo sapiens
  Payload ID: 10666
  Gene Symbol: MOG
  Gene Name: myelin oligodendrocyte glycoprotein
  ENSP ID: ENSP00000420250
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFESFGVLGPQVKEPKKTGQFLEELLFHLEALSG

SEQ ID NO: 53962 - protein, 108 aa, Homo sapiens
  Payload ID: 10666
  Gene Symbol: MOG
  Gene Name: myelin oligodendrocyte glycoprotein
  Uniprot ID: Q16653
  ENSP ID: ENSP00000420350
MASLSRPSLPSCLCSFLLLLLLQVSSSYADPFYWVSPGVLVLLAVLPVLLLQITVGLIFLCLQYRLRGKLRAEIENLHRTFESFGVLGPQVKEPKKTGQFLEELRNPF

SEQ ID NO: 53963 - protein, 208 aa, Homo sapiens [sequence omitted]

SEQ ID NO: 53964 - protein, 208 aa, Homo sapiens [sequence omitted]

SEQ ID NO: 53965 - protein, 208 aa, Homo sapiens [sequence omitted]

SEQ ID NO: 53966 - protein, 208 aa, Homo sapiens [sequence omitted]

SEQ ID NO: 53967 - protein, 208 aa, Homo sapiens [sequence omitted]

SEQ ID NO: 53968 - protein, 208 aa, Homo sapiens [sequence omitted]

SEQ ID NO: 53969 - protein, 52 aa, Homo sapiens
  Payload ID: 10667
  Gene Symbol: MPZ
  Gene Name: myelin protein zero
  ENSP ID: ENSP00000431441
MEKGKLHKPGKDASKRGRQTPVLYAMLDHSRSTKAVSEKKAKGLGESRKDKK

SEQ ID NO: 53970 - protein, 248 aa, Homo sapiens
  Payload ID: 10667
  Gene Symbol: MPZ
  Gene Name: myelin protein zero
  Uniprot ID: P25189
  ENSP ID: ENSP00000431538
MAPGAPSSSPSPILAVLLFSSLVLSPAQAIVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTRYGVVLGAVIGGVLGVVLLLLLLFYVVRYCWLRRQAALQRRLSAMEKGKLHKPGKDASKRGRQTPVLYAMLDHSRSTKAVSEKKAKGLGESRKDKK

SEQ ID NO: 53971 - protein, 248 aa, Homo sapiens; identical to SEQ ID NO: 53970
  Payload ID: 10667
  Gene Symbol: MPZ
  Gene Name: myelin protein zero
  Uniprot ID: P25189
  ENSP ID: ENSP00000432943

SEQ ID NO: 53972 - protein, 136 aa, Homo sapiens
  Payload ID: 10667
  Gene Symbol: MPZ
  Gene Name: myelin protein zero
  ENSP ID: ENSP00000488104
  MOD_RES (1)..(1): Any amino acid
XPYIDEVGTFKERIQWVGDPRWKDGSIVIHNLDYSDNVPTRYGVVLGAVIGGVLGVVLLLLLLFYVVRYCWLRRQAALQRRLSAMEKGKLHKPGKDASKRGRQTPVLYAMLDHSRSTKAVSEKKAKGLGESRKDKK

SEQ ID NO: 53973 - protein, 269 aa, Homo sapiens
  Payload ID: 10668
  Gene Symbol: MPZL1
  Gene Name: myelin protein zero-like 1
  Uniprot ID: O95297
  ENSP ID: ENSP00000352513
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKN

SEQ ID NO: 53974 - protein, 183 aa, Homo sapiens
  Payload ID: 10668
  Gene Symbol: MPZL1
  Gene Name: myelin protein zero-like 1
  ENSP ID: ENSP00000356827
PFSSVTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGAQSYMHS

SEQ ID NO: 53975 - protein, 119 aa, Homo sapiens
  Payload ID: 10668
  Gene Symbol: MPZL1
  Gene Name: myelin protein zero-like 1
  Uniprot ID: O95297
  ENSP ID: ENSP00000375968
MAASAGAGAVIAAPDSRRWLWSVLAAALGLLTAGVSALEVYTPKEIFVANGTQGKLTCKFKSTSTTGGLTSVSWSFQPEGADTTVSGPVIYAQLDHSGGHHSDKINKSESVVYADIRKN

SEQ ID NO: 53976 - protein, 95 aa, Homo sapiens
  Payload ID: 10668
  Gene Symbol: MPZL1
  Gene Name: myelin protein zero-like 1
  ENSP ID: ENSP00000399490
MAASAGAGAVIAAPDSRRWLWSVLAAALGLLTAGVSALEVYTPKEIFVANGTQGKLTCKFKSTSTTGGLTSVSWSFQPEGADTTVSRICLCFQFG

SEQ ID NO: 53977 - protein, 209 aa, Homo sapiens
  Payload ID: 10668
  Gene Symbol: MPZL1
  Gene Name: myelin protein zero-like 1
  Uniprot ID: O95297
  ENSP ID: ENSP00000420455
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGAQSYMHS

SEQ ID NO: 53978 - protein, 215 aa, Homo sapiens
  Payload ID: 10669
  Gene Symbol: MPZL2
  Gene Name: myelin protein zero-like 2
  Uniprot ID: O60487
  ENSP ID: ENSP00000278937
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 53979 - protein, 215 aa, Homo sapiens; identical to SEQ ID NO: 53978
  Payload ID: 10669
  Gene Symbol: MPZL2
  Gene Name: myelin protein zero-like 2
  Uniprot ID: O60487
  ENSP ID: ENSP00000408362

SEQ ID NO: 53980 - protein, 235 aa, Homo sapiens
  Payload ID: 10670
  Gene Symbol: MPZL3
  Gene Name: myelin protein zero-like 3
  Uniprot ID: Q6UWV2
  ENSP ID: ENSP00000278949
MQQRGAAGSRGCALFPLLGVLFFQGVYIVFSLEIRADAHVRGYVGEKIKLKCTFKSTSDVTDKLTIDWTYRPPSSSHTVSIFHYQSFQYPTTAGTFRDRISWVGNVYKGDASISISNPTIKDNGTFSCAVKNPPDVHHNIPMTELTVTERGFGTMLSSVALLSILVFVPSAVVVALLLVRMGRKAAGLKKRSRSGYKKSSIEVSDDTDQEEEEACMARLCVRCAECLDSDYEETY

SEQ ID NO: 53981 - protein, 108 aa, Homo sapiens
  Payload ID: 10670
  Gene Symbol: MPZL3
  Gene Name: myelin protein zero-like 3
  Uniprot ID: Q6UWV2
  ENSP ID: ENSP00000393594
MQQRGAAGSRGCALFPLLGVLFFQGVYIVFSLEIRADAHVRGYVGEKIKLKCTFKSTSDVTDKLTIDWTYRPPSSSHTVSVLAPCFPLWPFFPSLSLCPQPWWLLCCW

SEQ ID NO: 53982 - protein, 223 aa, Homo sapiens
  Payload ID: 10670
  Gene Symbol: MPZL3
  Gene Name: myelin protein zero-like 3
  Uniprot ID: Q6UWV2
  ENSP ID: ENSP00000432106
MQQRGAAGSRGCALFPLLGVLFFQDAHVRGYVGEKIKLKCTFKSTSDVTDKLTIDWTYRPPSSSHTVSIFHYQSFQYPTTAGTFRDRISWVGNVYKGDASISISNPTIKDNGTFSCAVKNPPDVHHNIPMTELTVTERGFGTMLSSVALLSILVFVPSAVVVALLLVRMGRKAAGLKKRSRSGYKKSSIEVSDDTDQEEEEACMARLCVRCAECLDSDYEETY

SEQ ID NO: 53983 - protein, 65 aa, Homo sapiens
  Payload ID: 10670
  Gene Symbol: MPZL3
  Gene Name: myelin protein zero-like 3
  ENSP ID: ENSP00000434636
MQQRGAAGSRGCALFPLLGVLFFQALIRRRKRRVWRGFVSVALSAWIQTMKRHIDESLYDTRRVT

SEQ ID NO: 53984 - protein, 1111 aa, Homo sapiens
  Payload ID: 10671
  Gene Symbol: MYRF
  Gene Name: myelin regulatory factor
  Uniprot ID: Q9Y2G1
  ENSP ID: ENSP00000265460
MHWLPAGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGRSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 53985 - protein, 1151 aa, Homo sapiens
  Payload ID: 10671
  Gene Symbol: MYRF
  Gene Name: myelin regulatory factor
  Uniprot ID: Q9Y2G1
  ENSP ID: ENSP00000278836
MEVVDETEALQRFFEGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGSFAVSTSCLLALLRPQPPGGSEALCPWSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSASLLAEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 53986 - protein, 537 aa, Homo sapiens
  Payload ID: 10671
  Gene Symbol: MYRF
  Gene Name: myelin regulatory factor
  ENSP ID: ENSP00000374253
MRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGSFAVSTSCLLALLRPQPPGGSEALCPWSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 53987 - protein, 250 aa, Homo sapiens
  Payload ID: 10672
  Gene Symbol: MYRFL
  Gene Name: myelin regulatory factor-like
  ENSP ID: ENSP00000299350
MVFLALTIVALYILSLKDQDRRVPNLPPSNITSSQEPALLPTASSSAPNTSLVTTPASLQVPEITFCEILPCQETYCCPIRGMKEVSSSPVQRQSEEKEFHQRRWSEDKSKSVLARNALSGPDWESDWIDTTISSIQIMEIQQIIDHQYCIQSLQCGTTEPLIVFQCKFTLGNICFHSKRGTKGLESHREISQEMTQGYQHIWSLPVAPFSDSMFHFRVAAPDLADCSTDPYFAGIFFTDYFFYFYRRCA

SEQ ID NO: 53988 - protein, 250 aa, Homo sapiens
  Payload ID: 10672
  Gene Symbol: MYRFL
  Gene Name: myelin regulatory factor-like
  ENSP ID: ENSP00000440626
MAFCALTIVALYILSLKDQDRRVPNLPPSNITSSQEPALLPTASSSAPNTSLVTTPASLQVPEITFCEILPCQETYCCPIRGMKEVSSSPVQRQSEEKEFHQRRWSEDKSKSVLARNALSGPDWESDWIDTTISSIQIMEIQQIIDHQYCIQSLQCGTTEPLIVFQCKFTLGNICFHSKRGTKGLESHREISQEMTQGYQHIWSLPVAPFSDSMFHFRVAAPDLADCSTDPYFAGIFFTDYFFYFYRRCA

SEQ ID NO: 53989 - protein, 375 aa, Homo sapiens
  Payload ID: 10672
  Gene Symbol: MYRFL
  Gene Name: myelin regulatory factor-like
  ENSP ID: ENSP00000447167
  MOD_RES (1)..(1): Any amino acid
XIFMENVGAVKQLCKLTNNLEERIEELEIWNRKLARLKRLSSWKSSASEASTISKSSRAVSASSPRRAVHKKNNKVYFSGKRQACPNWVFQTLVITLIAVMAFCALTIVALYILSLKDQDRRVPNLPPSNITSSQEPALLPTASSSAPNTSLVTTPASLQVPEITFCEILPCQETYCCPIRGMKEVSSSPVQRQSEEKEFHQRRWSEDKSKSVLARNALSGPDWESDWIDTTISSIQIMEIQQIIDHQYCIQSLQCGSGNYNYNIPVNKHTPTNVKFSLEINTTEPLIVFQCKFTLGNICFHSKRGTKGLESHREISQEMTQGYQHIWSLPVAPFSDSMFHFRVAAPDLADCSTDPYFAGIFFTDYFFYFYRRCA

SEQ ID NO: 53990 - protein, 910 aa, Homo sapiens
  Payload ID: 10672
  Gene Symbol: MYRFL
  Gene Name: myelin regulatory factor-like
  Uniprot ID: Q96LU7
  ENSP ID: ENSP00000448753
MDVVGENEALQQFFEAQGANGTLENPALDTSLLEEFLGNDFDLGALQRQLPDTPPYSASDSCSPPQVKGACYPTLRPTAGRTPAPFLHPTAAPAMPPMHPLQSTSGMGDSCQIHGGFHSCHSNASHLATPLDQSVSSHLGIGCSYPQQPLCHSPGASLPPTKKRKCTQALEDSGECRVWACHCRPMTSRSRSSEVQDPDSEGQNRMPTDQCSPALKWQPCHSVPWHSLLNSHYEKLPDVGYRVVTDKGFNFSPADEAFVCQKKNHFQITIHIQVWGSPKFVETEMGLKPIEMFYLKVFGTKVEATNQIIAIEQSQADRSKKIFNPVKIDLLADQVTKVTLGRLHFSETTANNMRKKGKPNPDQRYFMLVVGLYAANQDQFYLLSAHISERIIVRASNPGQFENDSDALWQRGQVPESIVCHGRVGINTDAPDEALVVCGNMKVMGTIMHPSDSRAKQNIQEVDTNEQLKRIAQMRIVEYDYKPEFASAMGINTAHQTGMIAQEVQEILPRAVREVGDVTCGNGETLENFLMVDKDQIFMENVGAVKQLCKLTNNLEERIEELEIWNRKLARLKRLSSWKSSASEASTISKSSRAVSASSPRRAVHKKNNKVYFSGKRQACPNWVFQTLVITLIAVMAFCALTIVALYILSLKDQDRRVPNLPPSNITSSQEPALLPTASSSAPNTSLVTTPASLQVPEITFCEILPCQETYCCPIRGMKEVSSSPVQRQSEEKEFHQRRWSEDKSKSVLARNALSGPDWESDWIDTTISSIQIMEIQQIIDHQYCIQSLQCGSGNYNYNIPVNKHTPTNVKFSLEINTTEPLIVFQCKFTLGNICFHSKRGTKGLESHREISQEMTQGYQHIWSLPVAPFSDSMFHFRVAAPDLADCSTDPYFAGIFFTDYFFYFYRRCA

SEQ ID NO: 53991 - protein, 898 aa, Homo sapiens
  Payload ID: 10672
  Gene Symbol: MYRFL
  Gene Name: myelin regulatory factor-like
  ENSP ID: ENSP00000449598
MDVVGENEALQQFFEAQGANGTLENPALDTSLLEEFLGNDFDLGALQRQLPDTPPYSASDSCSPPQVKGACYPTLRPTAGRTPAPFLHPTAAPAMPPMHPLQSTSGMGDSCQIHGGFHSCHSNASHLATPLDQSVSSHLGIGCSYPQQPLCHSPGASLPPTKKRKCTQALEDSGECRVWACHCRPMTSRSRSSEVQDPDSEGQNRMPTDQCSPALKWQPCHSVPWHSLLNSHYEKLPDVGYRVVTDKGFNFSPADEAFVCQKKNHFQITIHIQVWGSPKFVETEMGLKPIEMFYLKVFGTKVEATNQIIAIEQSQADRSKKIFNPVKIDLLADQVTKVTLGRLHFSETTANNMRKKGKPNPDQRYFMLVVGLYAANQDQFYLLSAHISERIIVRASNPGQFENDSDALWQRGQVPESIVCHGRVGINTDAPDEALVVCGNMKVMGTIMHPSDSRAKQNIQEVDTNEQLKRIAQMRIVEYDYKPEFASAMGINTAHQTGMIAQEVQEILPRAVREVGDVTCGNGETLENFLMVDKDQIFMENVGAVKQLCKLTNNLEERIEELEIWNRKLARLKRLSSWKSSASEASTISKSSRAVSASSPRRAVHKKNNKVYFSGKRQACPNWVFQTLVITLIAVMAFCLKDQDRRVPNLPPSNITSSQEPALLPTASSSAPNTSLVTTPASLQVPEITFCEILPCQETYCCPIRGMKEVSSSPVQRQSEEKEFHQRRWSDKSKSVLARNALSGPDWESDWIDTTISSIQIMEIQQIIDHQYCIQSLQCGSGNYNYNIPVNKHTPTNVKFSLEINTTEPLIVFQCKFTLGNICFHSKRGTKGLESHREISQEMTQGYQHIWSLPVAPFSDSMFHFRVAAPDLADCSTDPYFAGIFFTDYFFYFYRRCA

SEQ ID NO: 53992 - protein, 1121 aa, Homo sapiens
  Payload ID: 10673
  Gene Symbol: MYT1
  Gene Name: myelin transcription factor 1
  Uniprot ID: Q01538
  ENSP ID: ENSP00000327465
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAEQVRTVCEPGCPPAEQSQLGLGEPGKAAKPLDTVRKSYYSKDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQCFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLPHMEPICEQNFDAYVSTLTDMYSNQDPENKDLLESIKQAVRGIQV

SEQ ID NO: 53993 - protein, 591 aa, Homo sapiens
  Payload ID: 10673
  Gene Symbol: MYT1
  Gene Name: myelin transcription factor 1
  ENSP ID: ENSP00000353269
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQCFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRRCPTPGCDGSGHITGNYASHRSLSGCPRAKKSGVKVAPTKDDKEDPELMKYVGPCWLFHCIAELRFSCVL

SEQ ID NO: 53994 - protein, 1148 aa, Homo sapiens
  Payload ID: 10673
  Gene Symbol: MYT1
  Gene Name: myelin transcription factor 1
  Uniprot ID: Q01538
  ENSP ID: ENSP00000442412
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAEQVRTVCEPGCPPAEQSQLGLGEPGKAAKPLDTVRKSYYSKDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQSKPFPKASSPRHSPSSSYVRSTSSSSAGFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLPHMEPICEQNFDAYVSTLTDMYSNQDPENKDLLESIKQAVRGIQV

SEQ ID NO: 53995 - protein, 1121 aa, Homo sapiens; identical to SEQ ID NO: 53992
  Payload ID: 10673
  Gene Symbol: MYT1
  Gene Name: myelin transcription factor 1
  Uniprot ID: Q01538
  ENSP ID: ENSP00000477771

SEQ ID NO: 53996 - protein, 591 aa, Homo sapiens; identical to SEQ ID NO: 53993
  Payload ID: 10673
  Gene Symbol: MYT1
  Gene Name: myelin transcription factor 1
  ENSP ID: ENSP00000478819

SEQ ID NO: 53997 - protein, 591 aa, Homo sapiens; identical to SEQ ID NO: 53993
  Payload ID: 10673
  Gene Symbol: MYT1
  Gene Name: myelin transcription factor 1
  ENSP ID: ENSP00000480510

SEQ ID NO: 53998 - protein, 591 aa, Homo sapiens; identical to SEQ ID NO: 53993
  Payload ID: 10673
  Gene Symbol: MYT1
  Gene Name: myelin transcription factor 1
  ENSP ID: ENSP00000481863

SEQ ID NO: 53999 - protein, 1148 aa, Homo sapiens; identical to SEQ ID NO: 53994
  Payload ID: 10673
  Gene Symbol: MYT1
  Gene Name: myelin transcription factor 1
  Uniprot ID: Q01538
  ENSP ID: ENSP00000483021

SEQ ID NO: 54000 - protein, 202 aa, Homo sapiens
  Payload ID: 10674
  Gene Symbol: MYT1L
  Gene Name: myelin transcription factor 1-like
  ENSP ID: ENSP00000382111
EDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMEDGVWWGQ

SEQ ID NO: 54001 - protein, 1186 aa, Homo sapiens
  Payload ID: 10674
  Gene Symbol: MYT1L
  Gene Name: myelin transcription factor 1-like
  Uniprot ID: Q9UL68
  ENSP ID: ENSP00000382114
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 54002 - protein, 184 aa, Homo sapiens
  Payload ID: 10674
  Gene Symbol: MYT1L
  Gene Name: myelin transcription factor 1-like
  Uniprot ID: Q9UL68
  ENSP ID: ENSP00000384219
MSCPTPGCDGSGHVSGSFLTHRSLSGCPRATSAMKKAKLSGEQMLTIKQRASNGIENDEEIKQLDEEIKELNESNSQMEADMIKLRTQVTITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 54003 - protein, 1184 aa, Homo sapiens
  Payload ID: 10674
  Gene Symbol: MYT1L
  Gene Name: myelin transcription factor 1-like
  Uniprot ID: Q9UL68
  ENSP ID: ENSP00000396103
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 54004 - protein, 343 aa, Homo sapiens
  Payload ID: 10674
  Gene Symbol: MYT1L
  Gene Name: myelin transcription factor 1-like
  ENSP ID: ENSP00000473409
QERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKRSGTARTPAPAAAAPAATRPAAAAT

SEQ ID NO: 54005 - protein, 206 aa, Homo sapiens
  Payload ID: 10675
  Gene Symbol: MOBP
  Gene Name: myelin-associated oligodendrocyte basic protein
  Uniprot ID: Q13875
  ENSP ID: ENSP00000312293
MSQKPAKEGPRLSKNQKYSEHFSIHCCPPFTFLNSKKEIVDRKYSICKSGCFYQKKEEDWICCACQKTSSCQRRLSSRGEPWLPPPASFGPLRTSRRAKSPQRPKQQPAAPPAVVRAPAKPRSPPRSERQPRSPPRSERQPRSPPRSERQPRSPPRSERQPRPRPEVRPPPAKQRPPQKSKQQPRSSPLRGPGASRGGSPVKASRF

SEQ ID NO: 54006 - protein, 81 aa, Homo sapiens
  Payload ID: 10675
  Gene Symbol: MOBP
  Gene Name: myelin-associated oligodendrocyte basic protein
  Uniprot ID: Q13875
  ENSP ID: ENSP00000373261
MSQKPAKEGPRLSKNQKYSEHFSIHCCPPFTFLNSKKEIVDRKYSICKSGCFYQKKEEDWICCACQKTRLKRKIRPTPKKK

SEQ ID NO: 54007 - protein, 81 aa, Homo sapiens; identical to SEQ ID NO: 54006
  Payload ID: 10675
  Gene Symbol: MOBP
  Gene Name: myelin-associated oligodendrocyte basic protein
  Uniprot ID: Q13875
  ENSP ID: ENSP00000388148

SEQ ID NO: 54008 - protein, 183 aa, Homo sapiens
  Payload ID: 10675
  Gene Symbol: MOBP
  Gene Name: myelin-associated oligodendrocyte basic protein
  Uniprot ID: Q13875
  ENSP ID: ENSP00000388827
MSQKPAKEGPRLSKNQKYSEHFSIHCCPPFTFLNSKKEIVDRKYSICKSGCFYQKKEEDWICCACQKTRTSRRAKSPQRPKQQPAAPPAVVRAPAKPRSPPRSERQPRSPPRSERQPRSPPRSERQPRSPPRSERQPRPRPEVRPPPAKQRPPQKSKQQPRSSPLRGPGASRGGSPVKASRFW

SEQ ID NO: 54009 - protein, 183 aa, Homo sapiens; identical to SEQ ID NO: 54008
  Payload ID: 10675
  Gene Symbol: MOBP
  Gene Name: myelin-associated oligodendrocyte basic protein
  Uniprot ID: Q13875
  ENSP ID: ENSP00000389055

SEQ ID NO: 54010 - protein, 183 aa, Homo sapiens; identical to SEQ ID NO: 54008
  Payload ID: 10675
  Gene Symbol: MOBP
  Gene Name: myelin-associated oligodendrocyte basic protein
  Uniprot ID: Q13875
  ENSP ID: ENSP00000400491

SEQ ID NO: 54011 - protein, 81 aa, Homo sapiens; identical to SEQ ID NO: 54006
  Payload ID: 10675
  Gene Symbol: MOBP
  Gene Name: myelin-associated oligodendrocyte basic protein
  Uniprot ID: Q13875
  ENSP ID: ENSP00000401312

SEQ ID NO: 54012 - protein, 81 aa, Homo sapiens; identical to SEQ ID NO: 54006
  Payload ID: 10675
  Gene Symbol: MOBP
  Gene Name: myelin-associated oligodendrocyte basic protein
  Uniprot ID: Q13875
  ENSP ID: ENSP00000405549

SEQ ID NO: 54013 - protein, 62 aa, Homo sapiens
  Payload ID: 10675
  Gene Symbol: MOBP
  Gene Name: myelin-associated oligodendrocyte basic protein
  ENSP ID: ENSP00000409071
MSVDIPLPTSEMSQKPAKEGPRLSKNQKYSEHFSIHCCPPFTFLNSKKEIVDRKYSICKSGC

SEQ ID NO: 54014 - protein, 81 aa, Homo sapiens; identical to SEQ ID NO: 54006
  Payload ID: 10675
  Gene Symbol: MOBP
  Gene Name: myelin-associated oligodendrocyte basic protein
  Uniprot ID: Q13875
  ENSP ID: ENSP00000409730

SEQ ID NO: 54015 - protein, 58 aa, Homo sapiens
  Payload ID: 10675
  Gene Symbol: MOBP
  Gene Name: myelin-associated oligodendrocyte basic protein
  ENSP ID: ENSP00000410720
MSQKPAKEGPRLSKNQKYSEHFSIHCCPPFTFLNSKKEIVDRKYSICKSGCFYQKKEE

SEQ ID NO: 54016 - protein, 182 aa, Homo sapiens
  Payload ID: 10675
  Gene Symbol: MOBP
  Gene Name: myelin-associated oligodendrocyte basic protein
  Uniprot ID: Q13875
  ENSP ID: ENSP00000413771
MSQKPAKEGPRLSKNQKYSEHFSIHCCPPFTFLNSKKEIVDRKYSICKSGCFYQKKEEDWICCACQKTRTSRRAKSPQRPKQQPAAPPAVVRAPAKPRSPPRSERQPRSPPRSERQPRSPPRSERQPRSPPRSERQPRPRPEVRPPPAKQRPPQKSKQQPRSSPLRGPGASRGGSPVKASRF

SEQ ID NO: 54017 - protein, 140 aa, Homo sapiens
  Payload ID: 10676
  Gene Symbol: MDS2
  Gene Name: myelodysplastic syndrome 2 translocation associated
  Uniprot ID: Q8NDY4
  ENSP ID: ENSP00000363683
MLQAADFIERTETAGELSRGLIGVLSSQISWCLLNVNLSKLPTRLQRLSCSVLNSSPAMRGGARGRPQLTLERPLRPGCRLHSCSEAEKGGFVRRKEIILFPPCEDPARGWLSANPGREPSPGICWHLNLGLPSLHNCEE

SEQ ID NO: 54018 - protein, 139 aa, Homo sapiens
  Payload ID: 10676
  Gene Symbol: MDS2
  Gene Name: myelodysplastic syndrome 2 translocation associated
  ENSP ID: ENSP00000483238
LQAADFIERTETAGELSRGLIGVLSSQISWCLLNVNLSKLPTRLQRLSCSVLNSSPAMRGGARGRPQLTLERPLRPGCRLHSCSEAEKGGFVRRKEIILFPPCEDPARGWLSANPGREPSPGICWHLNLGLPSLHNCEE

SEQ ID NO: 54019 - protein, 271 aa, Homo sapiens
  Payload ID: 10677
  Gene Symbol: MCL1
  Gene Name: myeloid cell leukemia 1
  Uniprot ID: Q07820
  ENSP ID: ENSP00000309973
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGWVCGVLPCRGPRRWHQECAAGFCRCCWSRSWFGISNKIALL

SEQ ID NO: 54020 - protein, 350 aa, Homo sapiens
  Payload ID: 10677
  Gene Symbol: MCL1
  Gene Name: myeloid cell leukemia 1
  Uniprot ID: Q07820
  ENSP ID: ENSP00000358022
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 54021 - protein, 197 aa, Homo sapiens
  Payload ID: 10677
  Gene Symbol: MCL1
  Gene Name: myeloid cell leukemia 1
  ENSP ID: ENSP00000477624
MFGLKRNAVIGLNLYCGGAGLGAGSGGATRPGGRLLATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 54022 - protein, 407 aa, Homo sapiens
  Payload ID: 10678
  Gene Symbol: MNDA
  Gene Name: myeloid cell nuclear differentiation antigen
  Uniprot ID: P41218
  ENSP ID: ENSP00000357123
MVNEYKKILLLKGFELMDDYHFTSIKSLLAYDLGLTTKMQEEYNRIKITDLMEKKFQGVACLDKLIELAKDMPSLKNLVNNLRKEKSKVAKKIKTQEKAPVKKINQEEVGLAAPAPTARNKLTSEARGRIPVAQKRKTPNKEKTEAKRNKVSQEQSKPPGPSGASTSAAVDHPPLPQTSSSTPSNTSFTPNQETQAQRQVDARRNVPQNDPVTVVVLKATAPFKYESPENGKSTMFHATVASKTQYFHVKVFDINLKEKFVRKKVITISDYSECKGVMEIKEASSVSDFNQNFEVPNRIIEIANKTPKISQLYKQASGTMVYGLFMLQKKSVHKKNTIYEIQDNTGSMDVVGSGKWHNIKCEKGDKLRLFCLQLRTVDRKLKLVCGSHSFIKVIKAKKNKEGPMNVN

SEQ ID NO: 54023 - protein, 104 aa, Homo sapiens
  Payload ID: 10678
  Gene Symbol: MNDA
  Gene Name: myeloid cell nuclear differentiation antigen
  ENSP ID: ENSP00000406800
  MOD_RES (1)..(1): Any amino acid
XPNRIIEIANKTPKISQLYKQASGTMVYGLFMLQKKSVHKKNTIYEIQDNTGSMDVVGSGKWHNIKCEKGDKLRLFCLQLRTVDRKLKLVIKAKKNKEGPMNVN

SEQ ID NO: 54024 - protein, 309 aa, Homo sapiens
  Payload ID: 10679
  Gene Symbol: MYD88
  Gene Name: myeloid differentiation primary response 88
  ENSP ID: ENSP00000379625
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRLIPIKYKAMKKEFPSILRFITVCDYTNPCTKSWFWTRLAKALSLP

SEQ ID NO: 54025 - protein, 264 aa, Homo sapiens
  Payload ID: 10679
  Gene Symbol: MYD88
  Gene Name: myeloid differentiation primary response 88
  ENSP ID: ENSP00000389979
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRLIPIKYKAMKKEFPSILRFITVCDYTNPCTKSWFWTRLAKALSLP

SEQ ID NO: 54026 - protein, 204 aa, Homo sapiens
  Payload ID: 10679
  Gene Symbol: MYD88
  Gene Name: myeloid differentiation primary response 88
  Uniprot ID: Q99836
  ENSP ID: ENSP00000390565
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGAAGWWWLSLMITCRARNVTSRPNLHSASLQVPIRSD

SEQ ID NO: 54027 - protein, 316 aa, Homo sapiens
  Payload ID: 10679
  Gene Symbol: MYD88
  Gene Name: myeloid differentiation primary response 88
  ENSP ID: ENSP00000391753
RPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRLARRPRGGCRRMVVVVSDDYLQSKECDFQTKFALSLSPGAHQKRLIPIKYKAMKKEFPSILRFITVCDYTNPCTKSWFWTRLAKALSLP

SEQ ID NO: 54028 - protein, 317 aa, Homo sapiens
  Payload ID: 10679
  Gene Symbol: MYD88
  Gene Name: myeloid differentiation primary response 88
  ENSP ID: ENSP00000401399
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRLARRPRGGCRRMVVVVSDDYLQSKECDFQTKFALSLSPGAHQKRLIPIKYKAMKKEFPSILRFITVCDYTNPCTKSWFWTRLAKALSLP

SEQ ID NO: 54029 - protein, 159 aa, Homo sapiens
  Payload ID: 10679
  Gene Symbol: MYD88
  Gene Name: myeloid differentiation primary response 88
  Uniprot ID: Q99836
  ENSP ID: ENSP00000417848
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIGAAGWWWLSLMITCRARNVTSRPNLHSASLQVPIRSD

SEQ ID NO: 54030 - protein, 268 aa, Homo sapiens
  Payload ID: 10680
  Gene Symbol: MLF1
  Gene Name: myeloid leukemia factor 1
  Uniprot ID: P58340
  ENSP ID: ENSP00000348157
MFRMLNSSFEDDPFFSESILAHRENMRQMIRSFSEPFGRDLLSISDGRGRAHNRRGHNDGEDSLTHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 54031 - protein, 243 aa, Homo sapiens
  Payload ID: 10680
  Gene Symbol: MLF1
  Gene Name: myeloid leukemia factor 1
  Uniprot ID: P58340
  ENSP ID: ENSP00000352025
MRQMIRSFSEPFGRDLLSISDGRGRAHNRRGHNDGEDSLTHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 54032 - protein, 299 aa, Homo sapiens
  Payload ID: 10680
  Gene Symbol: MLF1
  Gene Name: myeloid leukemia factor 1
  Uniprot ID: P58340
  ENSP ID: ENSP00000376568
MLKEVLQREGKSYKSETLMYIKKARASENKLSESILAHRENMRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 54033 - protein, 243 aa, Homo sapiens; identical to SEQ ID NO: 54031
  Payload ID: 10680
  Gene Symbol: MLF1
  Gene Name: myeloid leukemia factor 1
  Uniprot ID: P58340
  ENSP ID: ENSP00000417141

SEQ ID NO: 54034 - protein, 204 aa, Homo sapiens
  Payload ID: 10680
  Gene Symbol: MLF1
  Gene Name: myeloid leukemia factor 1
  ENSP ID: ENSP00000417278
MFRMLNSSFEDDPFFSESILAHRENMRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNE

SEQ ID NO: 54035 - protein, 258 aa, Homo sapiens
  Payload ID: 10680
  Gene Symbol: MLF1
  Gene Name: myeloid leukemia factor 1
  Uniprot ID: P58340
  ENSP ID: ENSP00000417777
MRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 54036 - protein, 243 aa, Homo sapiens; identical to SEQ ID NO: 54031
  Payload ID: 10680
  Gene Symbol: MLF1
  Gene Name: myeloid leukemia factor 1
  Uniprot ID: P58340
  ENSP ID: ENSP00000417835

SEQ ID NO: 54037 - protein, 200 aa, Homo sapiens
  Payload ID: 10680
  Gene Symbol: MLF1
  Gene Name: myeloid leukemia factor 1
  Uniprot ID: P58340
  ENSP ID: ENSP00000418595
MRQMIRSFSEPFGRDLLSISDGRGRAHNRRGHNDGEDSLTHTDVSSFQTMDQMVSNMRNYMQKLERNFIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 54038 - protein, 40 aa, Homo sapiens
  Payload ID: 10680
  Gene Symbol: MLF1
  Gene Name: myeloid leukemia factor 1
  ENSP ID: ENSP00000419241
MFRMLNSSFEDDPFFSHTGGLTLQQLKLKHKKPLELSSGH

SEQ ID NO: 54039 - protein, 188 aa, Homo sapiens
  Payload ID: 10680
  Gene Symbol: MLF1
  Gene Name: myeloid leukemia factor 1
  ENSP ID: ENSP00000419636
MTPSSRELREPGVRGRAGIKHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKR

SEQ ID NO: 54040 - protein, 174 aa, Homo sapiens
  Payload ID: 10680
  Gene Symbol: MLF1
  Gene Name: myeloid leukemia factor 1
  ENSP ID: ENSP00000419637
MRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEF

SEQ ID NO: 54041 - protein, 50 aa, Homo sapiens
  Payload ID: 10680
  Gene Symbol: MLF1
  Gene Name: myeloid leukemia factor 1
  ENSP ID: ENSP00000419775
MFRMLNSSFEDDPFFSWSYSAAAETEAQEALGTIIRTLSPFLHTEKICDR

SEQ ID NO: 54042 - protein, 258 aa, Homo sapiens; identical to SEQ ID NO: 54035
  Payload ID: 10680
  Gene Symbol: MLF1
  Gene Name: myeloid leukemia factor 1
  Uniprot ID: P58340
  ENSP ID: ENSP00000420134

SEQ ID NO: 54043 - protein, 191 aa, Homo sapiens
  Payload ID: 10680
  Gene Symbol: MLF1
  Gene Name: myeloid leukemia factor 1
  ENSP ID: ENSP00000420410
MDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKS

SEQ ID NO: 54044 - protein, 258 aa, Homo sapiens; identical to SEQ ID NO: 54035
  Payload ID: 10680
  Gene Symbol: MLF1
  Gene Name: myeloid leukemia factor 1
  Uniprot ID: P58340
  ENSP ID: ENSP00000483337

SEQ ID NO: 54045 - protein, 200 aa, Homo sapiens; identical to SEQ ID NO: 54037
  Payload ID: 10680
  Gene Symbol: MLF1
  Gene Name: myeloid leukemia factor 1
  Uniprot ID: P58340
  ENSP ID: ENSP00000484169

SEQ ID NO: 54046 - protein, 248 aa, Homo sapiens
  Payload ID: 10681
  Gene Symbol: MLF2
  Gene Name: myeloid leukemia factor 2
  Uniprot ID: Q15773
  ENSP ID: ENSP00000203630
MFRFMRDVEPEDPMFLMDPFAIHRQHMSRMLSGGFGYSPFLSITDGNMPGTRPASRRMQQAGAVSPFGMLGMSGGFMDMFGMMNDMIGNMEHMTAGGNCQTFSSSTVISYSNTGDGAPKVYQETSEMRSAPGGIRETRRTVRDSDSGLEQMSIGHHIRDRAHILQRSRNHRTGDQEERQDYINLDESEAAAFDDEWRRETSRFRQQRPLEFRRLESSGAGGRRAEGPPRLAIQGPEDSPSRQSRRYDW

SEQ ID NO: 54047 - protein, 248 aa, Homo sapiens; identical to SEQ ID NO: 54046
  Payload ID: 10681
  Gene Symbol: MLF2
  Gene Name: myeloid leukemia factor 2
  Uniprot ID: Q15773
  ENSP ID: ENSP00000403941

SEQ ID NO: 54048 - protein, 248 aa, Homo sapiens; identical to SEQ ID NO: 54046
  Payload ID: 10681
  Gene Symbol: MLF2
  Gene Name: myeloid leukemia factor 2
  Uniprot ID: Q15773
  ENSP ID: ENSP00000438671

SEQ ID NO: 54049 - protein, 230 aa, Homo sapiens
  Payload ID: 10681
  Gene Symbol: MLF2
  Gene Name: myeloid leukemia factor 2
  ENSP ID: ENSP00000439789
MFRFMRDVEPEDPMFLMDPFAIHRQHMSRMLSGGFGYSPFLSITDGNMPGTRPASRRMQQAGAVSPFGMLGMSGGFMDMFGMMNDMIGNMEHMTAGGNCQTFSSSTVISYSNTGDGAPKVYQETSEMRSAPGGVSWGALLSQRRSGRHGGLFGIQTVDWSRCPLGITSGTGLTSSSAPETIARGTRRSGRTISTWMRVRPQRLMTSGGGRPPDSGSSVPWSFGGLSPQGL

SEQ ID NO: 54050 - protein, 79 aa, Homo sapiens
  Payload ID: 10681
  Gene Symbol: MLF2
  Gene Name: myeloid leukemia factor 2
  ENSP ID: ENSP00000442444
MFRFMRDVEPEDPMFLMDPFAIHRQHMSRMLSGGFGYSPFLSITDGNMPGTRPASRRMQQAGAVSPFGMLGMSGGFMDM

SEQ ID NO: 54051 - protein, 121 aa, Homo sapiens
  Payload ID: 10681
  Gene Symbol: MLF2
  Gene Name: myeloid leukemia factor 2
  ENSP ID: ENSP00000443829
MFRFMRDVEPEDPMFLMDPFAIHRQHMSRMLSGGFGYSPFLSITDGNMPGTRPASRRMQQAGAVSPFGMLGMSGGFMDMFGMMNDMIGNMEHMTAGGNCQTFSSSTVISYSNTGDGAPKVY

SEQ ID NO: 54052 - protein, 248 aa, Homo sapiens; identical to SEQ ID NO: 54046
  Payload ID: 10681
  Gene Symbol: MLF2
  Gene Name: myeloid leukemia factor 2
  Uniprot ID: Q15773
  ENSP ID: ENSP00000446317

SEQ ID NO: 54053 - protein, 734 aa, Homo sapiens
  Payload ID: 10682
  Gene Symbol: MZF1
  Gene Name: myeloid zinc finger 1
  Uniprot ID: P28698
  ENSP ID: ENSP00000215057
MRPAVLGSPDRAPPEDEGPVMVKLEDSEEEGEAALWDPGPEAARLRFRCFRYEEATGPQEALAQLRELCRQWLRPEVRSKEQMLELLVLEQFLGALPPEIQARVQGQRPGSPEEAAALVDGLRREPGGPRRWVTVQVQGQEVLSEKMEPSSFQPLPETEPPTPEPGPKTPPRTMQESPLGLQVKEESEVTEDSDFLESGPLAATQESVPTLLPEEAQRCGTVLDQIFPHSKTGPEGPSWREHPRALWHEEAGGIFSPGFALQLGSISAGPGSVSPHLHVPWDLGMAGLSGQIQSPSREGGFAHALLLPSDLRSEQDPTDEDPCRGVGPALITTRWRSPRGRSRGRPSTGGGVVRGGRCDVCGKVFSQRSNLLRHQKIHTGERPFVCSECGRSFSRSSHLLRHQLTHTEERPFVCGDCGQGFVRSARLEEHRRVHTGEQPFRCAECGQSFRQRSNLLQHQRIHGDPPGPGAKPPAPPGAPEPPGPFPCSECRESFARRAVLLEHQAVHTGDKSFGCVECGERFGRRSVLLQHRRVHSGERPFACAECGQSFRQRSNLTQHRRIHTGERPFACAECGKAFRQRPTLTQHLRVHTGEKPFACPECGQRFSQRLKLTRHQRTHTGEKPYHCGECGLGFTQVSRLTEHQRIHTGERPFACPECGQSFRQHANLTQHRRIHTGERPYACPECGKAFRQRPTLTQHLRTHRREKPFACQDCGRRFHQSTKLIQHQRVHSAE

SEQ ID NO: 54054 - protein, 290 aa, Homo sapiens
  Payload ID: 10682
  Gene Symbol: MZF1
  Gene Name: myeloid zinc finger 1
  Uniprot ID: P28698
  ENSP ID: ENSP00000469378
MRPAVLGSPDRAPPEDEGPVMVKLEDSEEEGEAALWDPGPEAARLRFRCFRYEEATGPQEALAQLRELCRQWLRPEVRSKEQMLELLVLEQFLGALPPEIQARVQGQRPGSPEEAAALVDGLRREPGGPRRWVTVQVQGQEVLSEKMEPSSFQPLPETEPPTPEPGPKTPPRTMQESPLGLQVKEESEVTEDSDFLESGPLAATQESVPTLLPEEAQRCGTVLDQIFPHSKTGPEGPSWREHPRALWHEEAGGIFSPGAGAGAAPALGAGWLGAAVAMYVARCSANAATC

SEQ ID NO: 54055 - protein, 734 aa, Homo sapiens; identical to SEQ ID NO: 54053
  Payload ID: 10682
  Gene Symbol: MZF1
  Gene Name: myeloid zinc finger 1
  Uniprot ID: P28698
  ENSP ID: ENSP00000469493

SEQ ID NO: 54056 - protein, 259 aa, Homo sapiens
  Payload ID: 10682
  Gene Symbol: MZF1
  Gene Name: myeloid zinc finger 1
  ENSP ID: ENSP00000472123
MRPAVLGSPDRAPPEDEGPVMVKLEDSEEEGEAALWDPGPEAARLRFRCFRYEEATGPQEALAQLRELCRQWLRPEVRSKEQMLELLVLEQFLGALPPEIQARVQGQRPGSPEEAAALVDGLRREPGGPRRWVTVQVQGQEVLSEKMEPSSFQPLPETEPPTPEPGPKTPPRTMQESPLGLQVKEESEVTEDSDFLESGPLAATQESVPTLLPEEAQRCGTVLDQIFPHSKTGPEGPSWREHPRALWHEEAGGIFSPGK

SEQ ID NO: 54057 - protein, 63 aa, Homo sapiens
  Payload ID: 10682
  Gene Symbol: MZF1
  Gene Name: myeloid zinc finger 1
  ENSP ID: ENSP00000472454
MRPAVLGSPDRAPPEDEGPVMVKLEDSEEEGEAALWDPGPEAARLRFRCFRYEEATGPQEALA

SEQ ID NO: 54058 - protein, 559 aa, Homo sapiens
  Payload ID: 10683
  Gene Symbol: MLLT1
  Gene Name: myeloid/lymphoid or mixed-lineage leukemia
  translocated to, 1
  Uniprot ID: Q03111
  ENSP ID: ENSP00000252674
MDNQCTVQVRLELGHRAQLRKKPTTEGFTHDWMVFVRGPEQCDIQHFVEKVVFWLHDSFPKPRRVCKEPPYKVEESGYAGFIMPIEVHFKNKEEPRKVCFTYDLFLNLEGNPPVNHLRCEKLTFNNPTTEFRYKLLRAGGVMVMPEGADTVSRPSPDYPMLPTIPLSAFSDPKKTKPSHGSKDANKESSKTSKPHKVTKEHRERPRKDSESKSSSKELEREQAKSSKDTSRKLGEGRLPKEEKAPPPKAAFKEPKMALKETKLESTSPKGGPPPPPPPPPRASSKRPATADSPKPSAKKQKKSSSKGSRSAPGTSPRTSSSSSFSDKKPAKDKSSTRGEKVKAESEPREAKKALEVEESNSEDEASFKSESAQSSPSNSSSSSDSSSDSDFEPSQNHSQGPLRSMVEDLQSEESDEDDSSSGEEAAGKTNPGRDSRLSFSDSESDNSADSSLPSREPPPPQKPPPPNSKVSGRRSPESCSKPEKILKKGTYDKAYTDELVELHRRLMALRERNVLQQIVNLIEETGHFNVTNTTFDFDLFSLDETTVRKLQSCLEAVAT

SEQ ID NO: 54059 - protein, 1068 aa, Homo sapiens
  Payload ID: 10684
  Gene Symbol: MLLT10
  Gene Name: myeloid/lymphoid or mixed-lineage leukemia
  translocated to, 10
  Uniprot ID: P55197
  ENSP ID: ENSP00000307411
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPEQHQAFLYQLMQHHHQQHHQPELQQLQIPGPTQIPINNLLAGTQAPPLHTATTNPFLTIHGDNASQKVARLSDKTGPVAQEKS

SEQ ID NO: 54060 - protein, 1068 aa, Homo sapiens; identical to SEQ ID NO: 54059
  Payload ID: 10684
  Gene Symbol: MLLT10
  Gene Name: myeloid/lymphoid or mixed-lineage leukemia
  translocated to, 10
  Uniprot ID: P55197
  ENSP ID: ENSP00000366258

SEQ ID NO: 54061 - protein, 1027 aa, Homo sapiens
  Payload ID: 10684
  Gene Symbol: MLLT10
  Gene Name: myeloid/lymphoid or mixed-lineage leukemia
  translocated to, 10
  Uniprot ID: P55197
  ENSP ID: ENSP00000366272
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNDRGDSSTLTKQELKFIGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPVHRHPHFTQLPPTHFSPSMEIMQVRK

SEQ ID NO: 54062 - protein, 126 aa, Homo sapiens
  Payload ID: 10684
  Gene Symbol: MLLT10
  Gene Name: myeloid/lymphoid or mixed-lineage leukemia
  translocated to, 10
  Uniprot ID: P55197
  ENSP ID: ENSP00000366295
MVSSDRPVSLEDEVSHSMKEMIGGCCVCSDERGWAENPLVYCDGHGCSVAVHQACYGIVQVPTGPWFCRKCESQERAARVAESRSVAQAKVQWCDLSPLQPLLPGFKRFSCLSLPNGMQFLLVSLI

SEQ ID NO: 54063 - protein, 179 aa, Homo sapiens
  Payload ID: 10684
  Gene Symbol: MLLT10
  Gene Name: myeloid/lymphoid or mixed-lineage leukemia
  translocated to, 10
  Uniprot ID: P55197
  ENSP ID: ENSP00000366304
MVSSDRPVSLEDEVSHSMKEMIGGCCVCSDERGWAENPLVYCDGHGCSVAVHQACYGIVQVPTGPWFCRKCESQERAARVMVCNSCWLASSENVTPGYIEHHCACASPHPRCLVSNVPPVSGALMHCFWACLTTAAFFGPQSFTTCHMSFLVSRDILFYIYGFMPFISVVIWRFKKERW

SEQ ID NO: 54064 - protein, 62 aa, Homo sapiens
  Payload ID: 10684
  Gene Symbol: MLLT10
  Gene Name: myeloid/lymphoid or mixed-lineage leukemia
  translocated to, 10
  ENSP ID: ENSP00000397800
  MOD_RES (1)..(1): Any amino acid
XENPLVYCDGHGCSVAVHQACYGIVQVPTGPWFCRKCESQERAARVVGPMWFVPCIFQRYNL

SEQ ID NO: 54065 - protein, 179 aa, Homo sapiens
  Payload ID: 10684
  Gene Symbol: MLLT10
  Gene Name: myeloid/lymphoid or mixed-lineage leukemia
  translocated to, 10
  ENSP ID: ENSP00000399883
  MOD_RES (1)..(1): Any amino acid
XSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTSIYNSNDVAVSFPNVVSGSGSSTPVSSSHLPQQSSGHLQQVGALSPSAVS

SEQ ID NO: 54066 - protein, 361 aa, Homo sapiens
  Payload ID: 10684
  Gene Symbol: MLLT10
  Gene Name: myeloid/lymphoid or mixed-lineage leukemia
  translocated to, 10
  ENSP ID: ENSP00000408281
VTTEKTYTSTSNNSISGSLKRLEDTTARFTNANFQEVSAHTSSGKDVSETRGSEGKGKKSSAHSSGQRGRKPGGGRNPGTTVSAASPFPQAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNDRGDSSTLTKQELKFIGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPG

SEQ ID NO: 54067 - protein, 126 aa, Homo sapiens; identical to SEQ ID NO: 54062
  Payload ID: 10684
  Gene Symbol: MLLT10
  Gene Name: myeloid/lymphoid or mixed-lineage leukemia
  translocated to, 10
  Uniprot ID: P55197
  ENSP ID: ENSP00000484335

SEQ ID NO: 54068 - protein, 1068 aa, Homo sapiens; identical to SEQ ID NO: 54059
  Payload ID: 10684
  Gene Symbol: MLLT10
  Gene Name: myeloid/lymphoid or mixed-lineage leukemia
  translocated to, 10
  Uniprot ID: P55197
  ENSP ID: ENSP00000488569

SEQ ID NO: 54069 - protein, 90 aa, Homo sapiens
  Payload ID: 10685
  Gene Symbol: MLLT11
  Gene Name: myeloid/lymphoid or mixed-lineage leukemia
  translocated to, 11
  Uniprot ID: Q13015
  ENSP ID: ENSP00000357917
MRDPVSSQYSSFLFWRMPIPELDLSELEGLGLSDTATYKVKDSSVGKMIGQATAADQEKNPEGDGLLEYSTFNFWRAPIASIHSFELDLL

SEQ ID NO: 54070 - protein, 162 aa, Homo sapiens
  Payload ID: 10686
  Gene Symbol: MLLT3
  Gene Name: myeloid/lymphoid or mixed-lineage leukemia
  translocated to, 3
  ENSP ID: ENSP00000369678
MKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 54071 - protein, 568 aa, Homo sapiens
  Payload ID: 10686
  Gene Symbol: MLLT3
  Gene Name: myeloid/lymphoid or mixed-lineage leukemia
  translocated to, 3
  Uniprot ID: P42568
  ENSP ID: ENSP00000369695
MASSCAVQVKLELGHRAQVRKKPTVEGFTHDWMVFVRGPEHSNIQHFVEKVVFHLHESFPRPKRVCKDPPYKVEESGYAGFILPIEVYFKNKEEPRKVRFDYDLFLHLEGHPPVNHLRCEKLTFNNPTEDFRRKLLKAGGDPNRSIHTSSSSSSSSSSSSSSSSSSSSSSSSSSSSSSSSSSSSSSSSSSTSFSKPHKLMKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 54072 - protein, 565 aa, Homo sapiens
  Payload ID: 10686
  Gene Symbol: MLLT3
  Gene Name: myeloid/lymphoid or mixed-lineage leukemia
  translocated to, 3
  Uniprot ID: P42568
  ENSP ID: ENSP00000485996
MCAVQVKLELGHRAQVRKKPTVEGFTHDWMVFVRGPEHSNIQHFVEKVVFHLHESFPRPKRVCKDPPYKVEESGYAGFILPIEVYFKNKEEPRKVRFDYDLFLHLEGHPPVNHLRCEKLTFNNPTEDFRRKLLKAGGDPNRSIHTSSSSSSSSSSSSSSSSSSSSSSSSSSSSSSSSSSSSSSSSSSTSFSKPHKLMKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 54073 - protein, 138 aa, Homo sapiens
  Payload ID: 10686
  Gene Symbol: MLLT3
  Gene Name: myeloid/lymphoid or mixed-lineage leukemia
  translocated to, 3
  ENSP ID: ENSP00000486193
MKDLHSDDNEEESDEVEDNDNDSEMERPVNRGGSRSRRVSLSDGSDSESSSASSPLHHEPPPPLLKTNNNQILEVKSPIKQSKSDKQIKNGECDKIVNLIEETGHFHITNTTFDFDLCSLDKTTVRKLQSYLETSGTS

SEQ ID NO: 54074 - protein, 1831 aa, Homo sapiens
  Payload ID: 10687
  Gene Symbol: MLLT4
  Gene Name: myeloid/lymphoid or mixed-lineage leukemia
  translocated to, 4
  ENSP ID: ENSP00000252692
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQEVDQVDQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGPNSYPGSTGAAVGAHDACRDAKEKRSKSQDADSPGSSGAPENLTFKERQRLFSQGQDVSNKVKASRKLTELENELNTK

SEQ ID NO: 54075 - protein, 1665 aa, Homo sapiens
  Payload ID: 10687
  Gene Symbol: MLLT4
  Gene Name: myeloid/lymphoid or mixed-lineage leukemia
  translocated to, 4
  ENSP ID: ENSP00000341118
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARQTAMPAISVLDLLQDEERRRQQQLEEMRKREAEDRARQEEERRRQEEERTKRDAEEKVMVL

SEQ ID NO: 54076 - protein, 1781 aa, Homo sapiens
  Payload ID: 10687
  Gene Symbol: MLLT4
  Gene Name: myeloid/lymphoid or mixed-lineage leukemia
  translocated to, 4
  ENSP ID: ENSP00000355771
MRFYFQDKAAGNFATKCIRVSSTATTQDVIETLAEKFRPDMRMLSSPKYSLYEVHVSGEERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGPNSYPGSTGAAVGAHDACRDAKEKRSKSQDADSPGSSGAPENLTFKERQRLFSQGQDVSNKVKASRKLTELENELNTK

SEQ ID NO: 54077 - protein, 1651 aa, Homo sapiens
  Payload ID: 10687
  Gene Symbol: MLLT4
  Gene Name: myeloid/lymphoid or mixed-lineage leukemia
  translocated to, 4
  Uniprot ID: P55196
  ENSP ID: ENSP00000375956
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARDEERRRQQQLEEMRKREAEDRARQEEERRRQEEERTKRDAEEKVMVL

SEQ ID NO: 54078 - protein, 1743 aa, Homo sapiens
  Payload ID: 10687
  Gene Symbol: MLLT4
  Gene Name: myeloid/lymphoid or mixed-lineage leukemia
  translocated to, 4
  Uniprot ID: P55196
  ENSP ID: ENSP00000375960
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKRRQEEGYYSRLEAERRRQHDEAARRLLEPEAPGPNSYPGSTGAAVGAHDACRDAKEKRSKSQDADSPGSSGAPENLTFKERQRLFSQGQDVSNKVKASRKLTELENELNTK

SEQ ID NO: 54079 - protein, 1834 aa, Homo sapiens
  Payload ID: 10687
  Gene Symbol: MLLT4
  Gene Name: myeloid/lymphoid or mixed-lineage leukemia
  translocated to, 4
  Uniprot ID: P55196
  ENSP ID: ENSP00000383623
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARTAMPAISVLDLLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGPNSYPGSTGAAVGAHDACRDAKEKRSKSQDADSPGSSGAPENLTFKERQRLFSQGQDVSNKVKASRKLTELENELNTK

SEQ ID NO: 54080 - protein, 247 aa, Homo sapiens
  Payload ID: 10687
  Gene Symbol: MLLT4
  Gene Name: myeloid/lymphoid or mixed-lineage leukemia
  translocated to, 4
  ENSP ID: ENSP00000383625
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGEERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDS

SEQ ID NO: 54081 - protein, 250 aa, Homo sapiens
  Payload ID: 10687
  Gene Symbol: MLLT4
  Gene Name: myeloid/lymphoid or mixed-lineage leukemia
  translocated to, 4
  ENSP ID: ENSP00000383626
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGEERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTL

SEQ ID NO: 54082 - protein, 1824 aa, Homo sapiens
  Payload ID: 10687
  Gene Symbol: MLLT4
  Gene Name: myeloid/lymphoid or mixed-lineage leukemia
  translocated to, 4
  Uniprot ID: P55196
  ENSP ID: ENSP00000404595
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGPNSYPGSTGAAVGAHDACRDAKEKRSKSQDADSPGSSGAPENLTFKERQRLFSQGQDVSNKVKASRKLTELENELNTK

SEQ ID NO: 54083 - protein, 389 aa, Homo sapiens
  Payload ID: 10687
  Gene Symbol: MLLT4
  Gene Name: myeloid/lymphoid or mixed-lineage leukemia
  translocated to, 4
  ENSP ID: ENSP00000414675
  MOD_RES (1)..(1): Any amino acid
XEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQVRSSRPAMLLQ

SEQ ID NO: 54084 - protein, 313 aa, Homo sapiens
  Payload ID: 10687
  Gene Symbol: MLLT4
  Gene Name: myeloid/lymphoid or mixed-lineage leukemia
  translocated to, 4
  ENSP ID: ENSP00000421441
  MOD_RES (1)..(1): Any amino acid
XLSPDPWKRDAKEKLEKQQQMHIVDMLSKEIQELQSKPDRSAEESDRLRKLMLEWQFQKRLQESKQKDEDDEEEEDDDVDTMLIMQRLEAERRARDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGPNSYPGSTGAAVGAHDACRDAKEKRSKSQDADSPGSSGAPENLTFKERQRLFSQGQDVSNKVKASRKLTELENELNTK

SEQ ID NO: 54085 - protein, 124 aa, Homo sapiens
  Payload ID: 10687
  Gene Symbol: MLLT4
  Gene Name: myeloid/lymphoid or mixed-lineage leukemia
  translocated to, 4
  ENSP ID: ENSP00000422166
  MOD_RES (1)..(1): Any amino acid
XDGVFLSNSFQPPSAKANSTAHKKGQPLPPPKKSSSYHPSHCKGRGPNSYPGSTGAAVGAHDACRDAKEKRSKSQDADSPGSSGAPENLTFKERQRLFSQGQDVSNKVKASRKLTELENELNTK

SEQ ID NO: 54086 - protein, 191 aa, Homo sapiens
  Payload ID: 10687
  Gene Symbol: MLLT4
  Gene Name: myeloid/lymphoid or mixed-lineage leukemia
  translocated to, 4
  ENSP ID: ENSP00000423035
  MOD_RES (1)..(1): Any amino acid
XRNASYLKTQVLSPDSLFTAKFVAYNEEEEEEDCSLAGQDKYSSTRKSHGDLLPAPLKPRPPPCQPRPASDGVFLSNSFQPPSAKANSTAHKKGQPLPPPKKSSSYHPSHCKGPNSYPGSTGAAVGAHDACRDAKEKRSKSQDADSPGSSGAPENLTFKERQRLFSQGQDVSNKVKASRKLTELENELNTK

SEQ ID NO: 54087 - protein, 129 aa, Homo sapiens
  Payload ID: 10687
  Gene Symbol: MLLT4
  Gene Name: myeloid/lymphoid or mixed-lineage leukemia
  translocated to, 4
  ENSP ID: ENSP00000424188
  MOD_RES (1)..(1): Any amino acid
XKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKVMVL

SEQ ID NO: 54088 - protein, 167 aa, Homo sapiens
  Payload ID: 10687
  Gene Symbol: MLLT4
  Gene Name: myeloid/lymphoid or mixed-lineage leukemia
  translocated to, 4
  ENSP ID: ENSP00000426462
AADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELASILRVP

SEQ ID NO: 54089 - protein, 1093 aa, Homo sapiens
  Payload ID: 10688
  Gene Symbol: MLLT6
  Gene Name: myeloid/lymphoid or mixed-lineage leukemia
  translocated to, 6
  ENSP ID: ENSP00000477969
MKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKVSSSASSSSHHEASTQETSESSRESKGKKSSSHSLSHKGKKLSSGKGVSSFTSASSSSSSSSSSSGGPFQPAVSSLQSSPDFSAFPKLEQPEEDKYSKPTAPAPSAPPSPSAPEPPKADLFEQKVVFSGFGPIMRFSTTTSSSGRARAPSPGDYKSPHVTGSGASAGTHKRMPALSATPVPADETPETGLKEKKHKASKRSRHGPGRPKGSRNKEGTGGPAAPSLPSAQLAGFTATAASPFSGGSLVSSGLGGLSSRTFGPSGSLPSLSLESPLLGAGIYTSNKDPISHSGGMLRAVCSTPLSSSLLGPPGTSALPRLSRSPFTSTLPSSSASISTTQVFSLAGSTFSLPSTHIFGTPMGAVNPLLSQAESSHTEPDLEDCSFRCRGTSPQESLSSMSPISSLPALFDQTASAPCGGGQLDPAAPGTTNMEQLLEKQGDGEAGVNIVEMLKALHALQKENQRLQEQILSLTAKKERLQILNVQLSVPFPALPAALPAANGPVPGPYGLPPQAGSSDSLSTSKSPPGKSSLGLDNSLSTSSEDPHSGCPSRSSSSLSFHSTPPPLPLLQQSPATLPLALPGAPAPLPPQPQNGLGRAPGAAGLGAMPMAEGLLGGLAGSGGLPLNGLLGGLNGAAAPNPASLSQAGGAPTLQLPGCLNSLTEQQRHLLQQQEQQLQQLQQLLASPQLTPEHQTVVYQMIQQIQQKRELQRLQMAGGSQLPMASLLAGSSTPLLSAGTPGLLPTASAPPLLPAGALVAPSLGNNTSLMAAAAAAAAVAAAGGPPVLTAQTNPFLSLSGAEGSGGGPKGGTADKGASANQEKG

SEQ ID NO: 54090 - protein, 325 aa, Homo sapiens
  Payload ID: 10688
  Gene Symbol: MLLT6
  Gene Name: myeloid/lymphoid or mixed-lineage leukemia
  translocated to, 6
  ENSP ID: ENSP00000479605
MKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKPRRGHQSPTNHGIGSLGCCLPDTPICLCPEGLSPGLLSAESGGRHSGLLSKF

SEQ ID NO: 54091 - protein, 302 aa, Homo sapiens
  Payload ID: 10688
  Gene Symbol: MLLT6
  Gene Name: myeloid/lymphoid or mixed-lineage leukemia
  translocated to, 6
  ENSP ID: ENSP00000479766
  MOD_RES (1)..(1): Any amino acid
XPAGIYTSNKDPISHSGGMLRAVCSTPLSSSLLGPPGTSALPRLSRSPFTSTLPSSSASISTTQVFSLAGSTFSLPSTHIFGTPMGAVNPLLSQAESSHTEPDLEDCSFRCRGTSPQESLSSMSPISSLPALFDQTASAPCGGGQLDPAAPGTTNMEQLLEKQGDGEAGVNIVEMLKALHALQKENQRLQEQILSLTAKKERLQILNVQLSVPFPALPAALPAANGPVPGPYGLPPQAGSSDSLSTSKSPPGKSSLGLDNSLSTSSEVGATRSGAGRRGRLKALLVPSLPRSYWRLGNEVTD

SEQ ID NO: 54092 - protein, 1093 aa, Homo sapiens; identical to SEQ ID NO: 54089
  Payload ID: 10688
  Gene Symbol: MLLT6
  Gene Name: myeloid/lymphoid or mixed-lineage leukemia
  translocated to, 6
  ENSP ID: ENSP00000479910

SEQ ID NO: 54093 - protein, 325 aa, Homo sapiens; identical to SEQ ID NO: 54090
  Payload ID: 10688
  Gene Symbol: MLLT6
  Gene Name: myeloid/lymphoid or mixed-lineage leukemia
  translocated to, 6
  ENSP ID: ENSP00000482928

SEQ ID NO: 54094 - protein, 302 aa, Homo sapiens; identical to SEQ ID NO: 54091
  Payload ID: 10688
  Gene Symbol: MLLT6
  Gene Name: myeloid/lymphoid or mixed-lineage leukemia
  translocated to, 6
  ENSP ID: ENSP00000487881
  MOD_RES (1)..(1): Any amino acid

SEQ ID NO: 54095 - protein, 322 aa, Homo sapiens
  Payload ID: 10689
  Gene Symbol: MYADM
  Gene Name: myeloid-associated differentiation marker
  Uniprot ID: Q96S97
  ENSP ID: ENSP00000337222
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGQPRRSRDVSCSRSHAYYVCAWDRRLAVAILTAINLLAYVADLVHSAHLVFVKV

SEQ ID NO: 54096 - protein, 322 aa, Homo sapiens; identical to SEQ ID NO: 54095
  Payload ID: 10689
  Gene Symbol: MYADM
  Gene Name: myeloid-associated differentiation marker
  Uniprot ID: Q96S97
  ENSP ID: ENSP00000375648

SEQ ID NO: 54097 - protein, 322 aa, Homo sapiens; identical to SEQ ID NO: 54095
  Payload ID: 10689
  Gene Symbol: MYADM
  Gene Name: myeloid-associated differentiation marker
  Uniprot ID: Q96S97
  ENSP ID: ENSP00000375649

SEQ ID NO: 54098 - protein, 322 aa, Homo sapiens; identical to SEQ ID NO: 54095
  Payload ID: 10689
  Gene Symbol: MYADM
  Gene Name: myeloid-associated differentiation marker
  Uniprot ID: Q96S97
  ENSP ID: ENSP00000375650

SEQ ID NO: 54099 - protein, 322 aa, Homo sapiens; identical to SEQ ID NO: 54095
  Payload ID: 10689
  Gene Symbol: MYADM
  Gene Name: myeloid-associated differentiation marker
  Uniprot ID: Q96S97
  ENSP ID: ENSP00000375651

SEQ ID NO: 54100 - protein, 242 aa, Homo sapiens
  Payload ID: 10689
  Gene Symbol: MYADM
  Gene Name: myeloid-associated differentiation marker
  ENSP ID: ENSP00000398269
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSG

SEQ ID NO: 54101 - protein, 188 aa, Homo sapiens
  Payload ID: 10689
  Gene Symbol: MYADM
  Gene Name: myeloid-associated differentiation marker
  ENSP ID: ENSP00000399722
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIF

SEQ ID NO: 54102 - protein, 146 aa, Homo sapiens
  Payload ID: 10689
  Gene Symbol: MYADM
  Gene Name: myeloid-associated differentiation marker
  ENSP ID: ENSP00000404958
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCI

SEQ ID NO: 54103 - protein, 259 aa, Homo sapiens
  Payload ID: 10689
  Gene Symbol: MYADM
  Gene Name: myeloid-associated differentiation marker
  ENSP ID: ENSP00000416919
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWP

SEQ ID NO: 54104 - protein, 307 aa, Homo sapiens
  Payload ID: 10690
  Gene Symbol: MYADML2
  Gene Name: myeloid-associated differentiation marker-like 2
  Uniprot ID: A6NDP7
  ENSP ID: ENSP00000327718
MGSTMEPPGGAYLHLGAVTSPVGTARVLQLAFGCTTFSLVAHRGGFAGVQGTFCMAAWGFCFAVSALVVACEFTRLHGCLRLSWGNFTAAFAMLATLLCATAAVLYPLYFARRECSPEPAGCAARDFRLAASVFAGLLFLAYAVEVALTRARPGQVSSYMATVSGLLKIVQAFVACIIFGALVHDSRYGRYVATQWCVAVYSLCFLATVAVVALSVMGHTGGLGCPFDRLVVVYTFLAVLLYLSAAVIWPVFCFDPKYGEPKRPPNCARGSCPWDSQLVVAIFTYVNLLLYVVDLAYSQRIRFVPSL

SEQ ID NO: 54105 - protein, 307 aa, Homo sapiens; identical to SEQ ID NO: 54104
  Payload ID: 10690
  Gene Symbol: MYADML2
  Gene Name: myeloid-associated differentiation marker-like 2
  Uniprot ID: A6NDP7
  ENSP ID: ENSP00000386702

SEQ ID NO: 54106 - protein, 173 aa, Homo sapiens
  Payload ID: 10691
  Gene Symbol: MYDGF
  Gene Name: myeloid-derived growth factor
  Uniprot ID: Q969H8
  ENSP ID: ENSP00000262947
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAVAHRPGAFKAELSKLVIVAKASRTEL

SEQ ID NO: 54107 - protein, 84 aa, Homo sapiens
  Payload ID: 10691
  Gene Symbol: MYDGF
  Gene Name: myeloid-derived growth factor
  ENSP ID: ENSP00000469136
  MOD_RES (1)..(1): Any amino acid
XHQHFTCTIWRPQGKSYLYFTQFKAEVRGAEIEYAMAYSKAAFERESDVPLKTEEFEVTKTAVISAPQEKGDDQPHWTDGETEA

SEQ ID NO: 54108 - protein, 189 aa, Homo sapiens
  Payload ID: 10691
  Gene Symbol: MYDGF
  Gene Name: myeloid-derived growth factor
  ENSP ID: ENSP00000469945
MAAPSGGWNGVGASLWAALLLGAVALRPAEAVSEPTTVAFDVRPGGVVHSFSHNVGPGDKYTCMFTYASQGGTNEQWQMSLGTSEDHQHFTCTIWRPQGKSYLYFTQFKAEVRGAEIEYAMAYSKAAFERESDVPLKTEEFEVTKTAGTERWGWGRGDATPIQGWAIGAVWRGGSAIGVLETVDQASTN

SEQ ID NO: 54109 - protein, 313 aa, Homo sapiens
  Payload ID: 10692
  Gene Symbol: MYEOV
  Gene Name: myeloma overexpressed
  Uniprot ID: Q96EZ4
  ENSP ID: ENSP00000308330
MALRICVTYTPALPIGLCTRCCLCLEQSPSWCHCLRGVSFLTFHLHQSVPLGDRDSLLMFTRQAGHFVEGSKAGRSRGRLCLSQALRVAVRGAFVSLWFAAGAGDRERNKGDKGAQTGAGLSQEAEDVDVSRARRVTDAPQGTLCGTGNRNSGSQSARVVGVAHLGEAFRVGVEQAISSCPEEVHGRHGLSMEIMWARMDVALRSPGRGLLAGAGALCMTLAESSCPDYERGRRACLTLHRHPTPHCSTWGLPLRVAGSWLTVVTVEALGGWRMGVRRTGQVGPTMHPPPVSGASPLLLHHLLLLLLIIILTC

SEQ ID NO: 54110 - protein, 313 aa, Homo sapiens; identical to SEQ ID NO: 54109
  Payload ID: 10692
  Gene Symbol: MYEOV
  Gene Name: myeloma overexpressed
  Uniprot ID: Q96EZ4
  ENSP ID: ENSP00000412482

SEQ ID NO: 54111 - protein, 255 aa, Homo sapiens
  Payload ID: 10692
  Gene Symbol: MYEOV
  Gene Name: myeloma overexpressed
  ENSP ID: ENSP00000438100
MFTRQAGHFVEGSKAGRSRGRLCLSQALRVAVRGAFVSLWFAAGAGDRERNKGDKGAQTGAGLSQEAEDVDVSRARRVTDAPQGTLCGTGNRNSGSQSARVVGVAHLGEAFRVGVEQAISSCPEEVHGRHGLSMEIMWARMDVALRSPGRGLLAGAGALCMTLAESSCPDYERGRRACLTLHRHPTPHCSTWGLPLRVAGSWLTVVTVEALGGWRMGVRRTGQVGPTMHPPPVSGASPLLLHHLLLLLLIIILTC

SEQ ID NO: 54112 - protein, 252 aa, Homo sapiens
  Payload ID: 10693
  Gene Symbol: MYEOV2
  Gene Name: myeloma overexpressed 2
  Uniprot ID: Q8WXC6
  ENSP ID: ENSP00000304147
MWRAPEAALRPEVSLERRGPEMKPAVDEMFPEGAGPYVDLDEVARARRESPSAGGSTGLLMDLAANEKAVHADFFNDFEDLFDDDDIHSSGLPRTSQQSSMVPALQRGQSEHGVRGKAAERPVVSEERCELNGREVAALDRAFGSTGHGQGAEALMFTRCREHPLCGTNKATSEGKMGTGRLRNSLRKNQSKWLGSYLEVLRTTRSRREVSEDSTISVSTHWRGKCFKSDETPSVAGGEEGKKTTQPCIDVR

SEQ ID NO: 54113 - protein, 49 aa, Homo sapiens
  Payload ID: 10693
  Gene Symbol: MYEOV2
  Gene Name: myeloma overexpressed 2
  ENSP ID: ENSP00000383946
MWRAPEAALRPEVSLERRGPEMKPAVDEMFPEGAGPYVDLDEAGGSTGL

SEQ ID NO: 54114 - protein, 57 aa, Homo sapiens
  Payload ID: 10693
  Gene Symbol: MYEOV2
  Gene Name: myeloma overexpressed 2
  Uniprot ID: Q8WXC6
  ENSP ID: ENSP00000475979
MKPAVDEMFPEGAGPYVDLDEAGGSTGLLMDLAANEKAVHADFFNDFEDLFDDDDIQ

SEQ ID NO: 54115 - protein, 745 aa, Homo sapiens
  Payload ID: 10694
  Gene Symbol: MPO
  Gene Name: myeloperoxidase
  Uniprot ID: P05164
  ENSP ID: ENSP00000225275
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 54116 - protein, 86 aa, Homo sapiens
  Payload ID: 10694
  Gene Symbol: MPO
  Gene Name: myeloperoxidase
  ENSP ID: ENSP00000464668
RYQPMEPNPRVPLSRVFFASWRVVLEGGIDPILRGLMATPAKLNRQNQIAVDEIRERLFEQISLPRIICDNTGITTVSKNNIFMSN

SEQ ID NO: 54117 - protein, 1858 aa, Homo sapiens
  Payload ID: 10695
  Gene Symbol:
  Gene Name: MYO16
  ENSP ID: ENSP00000488918
MEIDQCLLESLPLGQRQRLVKRMRCEQIKAYYEREKAFQKQEGFLKRLKHAKNPKVHFNLTDMLQDAIIHHNDKEVLRLLKEGADPHTLVSSGGSLLHLCARYDNAFIAEILIDRGVNVNHQDEDFWTPMHIACACDNPDIVLLLVLAGANVLLQDVNGNIPLDYAVEGTESSSILLTYLDENGVDLTSLRQMKLQRPMSMLTDVKHFLSSGGNVNEKNDEGVTLLHMACASGYKEVVSLILEHGGDLNIVDDQYWTPLHLAAKYGQTNLVKLLLMHQANPHLVNCNEEKASDIAASEFIEEMLLKAEIAWEEKMKEPLSASTLAQEEPYEEIIHDLPVLSSKLSPLVLPIAKQDSLLEKDIMFKDATKGLCKQQSQDSIPENPMMSGSTKPEQVKLMPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKTSENVVINHLFQSKLSQTGSLVSAYPSFKFRGHKSALLSKKMTASSIIGENKNYLELSKLLKKKGTSTFLQRLERGDPVTIASQLRKSLMDIIGKLQKCTPHFIHCIRPNNSKLPDTFDNFYVSAQLQYIGVLEMVKIFRYGYPVRLSFSDFLSRYKPLADTFLREKKEQSAAERCRLVLQQCKLQGWQMGVRKVFLKYWHADQLNDLCLQLQRKIITCQKVIRGFLARQHLLQRISIRQQEVTSINSFLQNTEDMGLKTYDALVIQNASDIARENDRLRSEMNAPYHKEKLEVRNMQEEGSKRTDDKSGPRHFHPSSMSVCAAVDGLGQCLVGPSIWSPSLHSVFSMDDSSSLPSPRKQPPPKPKRDPNTRLSASYEAVSACLSAAREAANEALARPRPHSDDYSTMKKIPPRKPKRSPNTKLSGSYEEISGSRPGDARPAGAPGAAARVLTPGTPQCALPPAAPPGDEDDSEPVYIEMLGHAARPDSPDPGESVYEEMKCCLPDDGGPGAGSFLLHGASPPLLHRAPEDEAAGPPGDACDIPPPFPNLLPHRPPLLVFPPTPVTCSPASDESPLTPLEVKKLPVLETNLKYPVQPEGSSPLSPQYSKSQKGDGDRPASPGLALFNGSGRASPPSTPPPPPPPPGPPPAPYRPCAHLAFPPEPAPVNAGKAGPSAEAPKVHPKPNSAPVAGPCSSFPKIPYSPVKATRADARKAGSSASPPAPYSPPSSRPLSSPLDELASLFNSGRSVLRKSAAGRKIREAEGFETNMNISSRDDPSTSEITSETQDRNANNHGIQLSNSLSSAITAENGNSISNGLPEEDGYSRLSISGTGTSTFQRHRDSHTTQVIHQLRLSENESVALQELLDWRRKLCEEGQDWQQILHHAEPRVPPPPPCKKPSLLKKPEGASCNRLPSELWDTTI

SEQ ID NO: 54118 - protein, 1880 aa, Homo sapiens
  Payload ID: 10695
  Gene Symbol:
  Gene Name: MYO16
  ENSP ID: ENSP00000488923
MSHYHFIKCCCFQLCNVFRSHEMEIDQCLLESLPLGQRQRLVKRMRCEQIKAYYEREKAFQKQEGFLKRLKHAKNPKVHFNLTDMLQDAIIHHNDKEVLRLLKEGADPHTLVSSGGSLLHLCARYDNAFIAEILIDRGVNVNHQDEDFWTPMHIACACDNPDIVLLLVLAGANVLLQDVNGNIPLDYAVEGTESSSILLTYLDENGVDLTSLRQMKLQRPMSMLTDVKHFLSSGGNVNEKNDEGVTLLHMACASGYKEVVSLILEHGGDLNIVDDQYWTPLHLAAKYGQTNLVKLLLMHQANPHLVNCNEEKASDIAASEFIEEMLLKAEIAWEEKMKEPLSASTLAQEEPYEEIIHDLPVLSSKLSPLVLPIAKQDSLLEKDIMFKDATKGLCKQQSQDSIPENPMMSGSTKPEQVKLMPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKTSENVVINHLFQSKLSQTGSLVSAYPSFKFRGHKSALLSKKMTASSIIGENKNYLELSKLLKKKGTSTFLQRLERGDPVTIASQLRKSLMDIIGKLQKCTPHFIHCIRPNNSKLPDTFDNFYVSAQLQYIGVLEMVKIFRYGYPVRLSFSDFLSRYKPLADTFLREKKEQSAAERCRLVLQQCKLQGWQMGVRKVFLKYWHADQLNDLCLQLQRKIITCQKVIRGFLARQHLLQRISIRQQEVTSINSFLQNTEDMGLKTYDALVIQNASDIARENDRLRSEMNAPYHKEKLEVRNMQEEGSKRTDDKSGPRHFHPSSMSVCAAVDGLGQCLVGPSIWSPSLHSVFSMDDSSSLPSPRKQPPPKPKRDPNTRLSASYEAVSACLSAAREAANEALARPRPHSDDYSTMKKIPPRKPKRSPNTKLSGSYEEISGSRPGDARPAGAPGAAARVLTPGTPQCALPPAAPPGDEDDSEPVYIEMLGHAARPDSPDPGESVYEEMKCCLPDDGGPGAGSFLLHGASPPLLHRAPEDEAAGPPGDACDIPPPFPNLLPHRPPLLVFPPTPVTCSPASDESPLTPLEVKKLPVLETNLKYPVQPEGSSPLSPQYSKSQKGDGDRPASPGLALFNGSGRASPPSTPPPPPPPPGPPPAPYRPCAHLAFPPEPAPVNAGKAGPSAEAPKVHPKPNSAPVAGPCSSFPKIPYSPVKATRADARKAGSSASPPAPYSPPSSRPLSSPLDELASLFNSGRSVLRKSAAGRKIREAEGFETNMNISSRDDPSTSEITSETQDRNANNHGIQLSNSLSSAITAENGNSISNGLPEEDGYSRLSISGTGTSTFQRHRDSHTTQVIHQLRLSENESVALQELLDWRRKLCEEGQDWQQILHHAEPRVPPPPPCKKPSLLKKPEGASCNRLPSELWDTTI

SEQ ID NO: 54119 - protein, 940 aa, Homo sapiens
  Payload ID: 10695
  Gene Symbol:
  Gene Name: MYO16
  ENSP ID: ENSP00000489279
MEIDQCLLESLPLGQRQRLVKRMRCEQIKAYYEREKAFQKQEGFLKRLKHAKNPKVHFNLTDMLQDAIIHHNDKEVLRLLKEGADPHTLVSSGGSLLHLCARYDNAFIAEILIDRGVNVNHQDEDFWTPMHIACACDNPDIVLLLVLAGANVLLQDVNGNIPLDYAVEGTESSSILLTYLDENGVDLTSLRQMKLQRPMSMLTDVKHFLSSGGNVNEKNDEGVTLLHMACASGYKEVVSLILEHGGDLNIVDDQYWTPLHLAAKYGQTNLVKLLLMHQANPHLVNCNEEKASDIAASEFIEEMLLKAEIAWEEKMKEPLSASTLAQEEPYEEIIHDLPVLSSKLSPLVLPIAKQDSLLEKDIMFKDATKGLCKQQSQDSIPENPMMSGSTKPEQVKLMPPAPNDDLATLSELNDGSLLYEIQKRFGNNQIYTFIGDILLLVNPYKELPIYSSMVSQLYFSSSGKLCSSLPPHLFSCVERAFHQLFREQRPQCFILSGERGSGKSEASKQIIRHLTCRAGASRATLDSRFKHVVCILEAFGHAKTTLNDLSSCFIKYFELQFCERKQQLTGARIYTYLLEKSRLVSQPLGQSNFLIFYLLMDGLSAEEKYGLHLNNLCAHRYLNQTIQDDASTGERSLNREKLAVLKRALNVVGFSSLEVENLFVILAAILHLGDIRFTALNEGNSAFVSDLQLLEQVAGMLQVSTDELASALTTDIQYFKGDMIIRRHTIQIAEFFRDLLAKSLYSRLFSFLVNTMNSCLHSQDEQKSMQTLDIGILDIFGFEEFQKNEFEQLCVNMTNEKMHHYINEVLFLHEQVECVQEGVTMETAYSPGNQNGVLDFFFQKPSGFLTLLDEESQMIWSVESNFPKKLQSLLESSNTNAVYSPMKDGNGNVALKDHGTAFTIMHYAGRVMYDVVGAIEKNKDSLSQNLLFVMKRGRCF

SEQ ID NO: 54120 - protein, 1858 aa, Homo sapiens; identical to SEQ ID NO: 54117
  Payload ID: 10695
  Gene Symbol:
  Gene Name: MYO16
  ENSP ID: ENSP00000489329

SEQ ID NO: 54121 - protein, 466 aa, Homo sapiens; identical to SEQ ID NO: 36341
  Payload ID: 10696
  Gene Symbol: MYZAP
  Gene Name: myocardial zonula adherens protein
  Uniprot ID: P0CAP1
  ENSP ID: ENSP00000267853

SEQ ID NO: 54122 - protein, 438 aa, Homo sapiens; identical to SEQ ID NO: 36347
  Payload ID: 10696
  Gene Symbol: MYZAP
  Gene Name: myocardial zonula adherens protein
  Uniprot ID: P0CAP1
  ENSP ID: ENSP00000369939

SEQ ID NO: 54123 - protein, 122 aa, Homo sapiens
  Payload ID: 10696
  Gene Symbol: MYZAP
  Gene Name: myocardial zonula adherens protein
  ENSP ID: ENSP00000431396
QAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGEPNRQDS

SEQ ID NO: 54124 - protein, 132 aa, Homo sapiens
  Payload ID: 10696
  Gene Symbol: MYZAP
  Gene Name: myocardial zonula adherens protein
  ENSP ID: ENSP00000457126
MEISLVKCSEANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLE

SEQ ID NO: 54125 - protein, 938 aa, Homo sapiens
  Payload ID: 10697
  Gene Symbol: MYOCD
  Gene Name: myocardin
  Uniprot ID: Q8IZQ8
  ENSP ID: ENSP00000341835
MTLLGSEHSLLIRSKFRSVLQLRLQQRRTQEQLANQGIIPPLKRPAEFHEQRKHLDSDKAKNSLKRKARNRCNSADLVNMHILQASTAERSIPTAQMKLKRARLADDLNEKIALRPGPLELVEKNILPVDSAVKEAIKGNQVSFSKSTDAFAFEEDSSSDGLSPDQTRSEDPQNSAGSPPDAKASDTPSTGSLGTNQDLASGSENDRNDSASQPSHQSDAGKQGLGPPSTPIAVHAAVKSKSLGDSKNRHKKPKDPKPKVKKLKYHQYIPPDQKAEKSPPPMDSAYARLLQQQQLFLQLQILSQQQQQQQHRFSYLGMHQAQLKEPNEQMVRNPNSSSTPLSNTPLSPVKNSFSGQTGVSSFKPGPLPPNLDDLKVSELRQQLRIRGLPVSGTKTALMDRLRPFQDCSGNPVPNFGDITTVTFPVTPNTLPNYQSSSSTSALSNGFYHFGSTSSSPPISPASSDLSVAGSLPDTFNDASPSFGLHPSPVHVCTEESLMSSLNGGSVPSELDGLDSEKDKMLVEKQKVINELTWKLQQEQRQVEELRMQLQKQKRNNCSEKKPLPFLAASIKQEEAVSSCPFASQVPVKRQSSSSECHPPACEAAQLQPLGNAHCVESSDQTNVLSSTFLSPQCSPQHSPLGAVKSPQHISLPPSPNNPHFLPSSSGAQGEGHRVSSPISSQVCTAQMAGLHSSDKVGPKFSIPSPTFSKSSSAISEVTQPPSYEDAVKQQMTRSQQMDELLDVLIESGEMPADAREDHSCLQKVPKIPRSSRSPTAVLTKPSASFEQASSGSQIPFDPYATDSDEHLEVLLNSQSPLGKMSDVTLLKIGSEEPHFDGIMDGFSGKAAEDLFNAHEILPGPLSPMQTQFSPSSVDSNGLQLSFTESPWETMEWLDLTPPNSTPGFSALTTSSPSIFNIDFLDVTDLNLNSSMDLHLQQW

SEQ ID NO: 54126 - protein, 648 aa, Homo sapiens
  Payload ID: 10697
  Gene Symbol: MYOCD
  Gene Name: myocardin
  ENSP ID: ENSP00000400148
FLQLQILSQQQQQQQHRFSYLGMHQAQLKEPNEQMVRNPNSSSTPLSNTPLSPVKNSFSGQTGVSSFKPGPLPPNLDDLKVSELRQQLRIRGLPVSGTKTALMDRLRPFQDCSGNPVPNFGDITTVTFPVTPNTLPNYQSSSSTSALSNGFYHFGSTSSSPPISPASSDLSVAGSLPDTFNDASPSFGLHPSPVHVCTEESLMSSLNGGSVPSELDGLDSEKDKMLVEKQKVINELTWKLQQEQRQVEELRMQLQKQKRNNCSEKKPLPFLAASIKQEEAVSSCPFASQVPVKRQSSSSECHPPACEAAQLQPLGNAHCVESSDQTNVLSSTFLSPQCSPQHSPLGAVKSPQHISLPPSPNNPHFLPSSSGAQGEGHRVSSPISSQVCTAQNSGAHDGHPPSFSPHSSSLHPPFSGAQADSSHGAGGNPCPKSPCVQQKQMTRSQQMDELLDVLIESGEMPADAREDHSCLQKVPKIPRSSRSPTAVLTKPSASFEQASSGSQIPFDPYATDSDEHLEVLLNSQSPLGKMSDVTLLKIGSEEPHFDGIMDGFSGKAAEDLFNAHEILPGPLSPMQTQFSPSSVDSNGLQLSFTESPWETMEWLDLTPPNSTPGFSALTTSSPSIFNIDFLDVTDLNLNSSMDLHLQQW

SEQ ID NO: 54127 - protein, 986 aa, Homo sapiens
  Payload ID: 10697
  Gene Symbol: MYOCD
  Gene Name: myocardin
  Uniprot ID: Q8IZQ8
  ENSP ID: ENSP00000401678
MTLLGSEHSLLIRSKFRSVLQLRLQQRRTQEQLANQGIIPPLKRPAEFHEQRKHLDSDKAKNSLKRKARNRCNSADLVNMHILQASTAERSIPTAQMKLKRARLADDLNEKIALRPGPLELVEKNILPVDSAVKEAIKGNQVSFSKSTDAFAFEEDSSSDGLSPDQTRSEDPQNSAGSPPDAKASDTPSTGSLGTNQDLASGSENDRNDSASQPSHQSDAGKQGLGPPSTPIAVHAAVKSKSLGDSKNRHKKPKDPKPKVKKLKYHQYIPPDQKAEKSPPPMDSAYARLLQQQQLFLQLQILSQQQQQQQHRFSYLGMHQAQLKEPNEQMVRNPNSSSTPLSNTPLSPVKNSFSGQTGVSSFKPGPLPPNLDDLKVSELRQQLRIRGLPVSGTKTALMDRLRPFQDCSGNPVPNFGDITTVTFPVTPNTLPNYQSSSSTSALSNGFYHFGSTSSSPPISPASSDLSVAGSLPDTFNDASPSFGLHPSPVHVCTEESLMSSLNGGSVPSELDGLDSEKDKMLVEKQKVINELTWKLQQEQRQVEELRMQLQKQKRNNCSEKKPLPFLAASIKQEEAVSSCPFASQVPVKRQSSSSECHPPACEAAQLQPLGNAHCVESSDQTNVLSSTFLSPQCSPQHSPLGAVKSPQHISLPPSPNNPHFLPSSSGAQGEGHRVSSPISSQVCTAQNSGAHDGHPPSFSPHSSSLHPPFSGAQADSSHGAGGNPCPKSPCVQQKMAGLHSSDKVGPKFSIPSPTFSKSSSAISEVTQPPSYEDAVKQQMTRSQQMDELLDVLIESGEMPADAREDHSCLQKVPKIPRSSRSPTAVLTKPSASFEQASSGSQIPFDPYATDSDEHLEVLLNSQSPLGKMSDVTLLKIGSEEPHFDGIMDGFSGKAAEDLFNAHEILPGPLSPMQTQFSPSSVDSNGLQLSFTESPWETMEWLDLTPPNSTPGFSALTTSSPSIFNIDFLDVTDLNLNSSMDLHLQQW

SEQ ID NO: 54128 - protein, 41 aa, Homo sapiens
  Payload ID: 10697
  Gene Symbol: MYOCD
  Gene Name: myocardin
  ENSP ID: ENSP00000462694
MTLLGSEHSLLIRSKFRSVLQLRLQQRRTQEQLANQGIIPH

SEQ ID NO: 54129 - protein, 504 aa, Homo sapiens
  Payload ID: 10698
  Gene Symbol: MYOC
  Gene Name: myocilin, trabecular meshwork inducible glucocorticoid response
  Uniprot ID: Q99972
  ENSP ID: ENSP00000037502
MRFFCARCCSFGPEMPAVQLLLLACLVWDVGARTAQLRKANDQSGRCQYTFSVASPNESSCPEQSQAMSVIHNLQRDSSTQRLDLEATKARLSSLESLLHQLTLDQAARPQETQEGLQRELGTLRRERDQLETQTRELETAYSNLLRDKSVLEEEKKRLRQENENLARRLESSSQEVARLRRGQCPQTRDTARAVPPGSREVSTWNLDTLAFQELKSELTEVPASRILKESPSGYLRSGEGDTGCGELVWVGEPLTLRTAETITGKYGVWMRDPKPTYPYTQETTWRIDTVGTDVRQVFEYDLISQFMQGYPSKVHILPRPLESTGAVVYSGSLYFQGAESRTVIRYELNTETVKAEKEIPGAGYHGQFPYSWGGYTDIDLAVDEAGLWVIYSTDEAKGAIVLSKLNPENLELEQTWETNIRKQSVANAFIICGTLYTVSSYTSADATVNFAYDTGTGISKTLTIPFKNRYKYSSMIDYNPLEKKLFAWDNLNMVTYDIKLSKM

SEQ ID NO: 54130 - protein, 344 aa, Homo sapiens
  Payload ID: 10698
  Gene Symbol: MYOC
  Gene Name: myocilin, trabecular meshwork inducible glucocorticoid response
  ENSP ID: ENSP00000478680
MRFFCARCCSFGPEMPAVQLLLLACLVWDVGARTAQLRKANDQSGRCQYTFSVASPNESSCPEQSQAMSVIHNLQRDSSTQRLDLEATKARLSSLESLLHQLTLDQAARPQETQEGLQRELGTLRRERDQLETQTRELETAYSNLLRDKSVLEEEKKRLRQENENLARRLESSSQEVARLRRGQCPQTRDTARAVPPGSREVSTWNLDTLAFQELKSELTEVPASRILKESPSGYLRSGEGDTGCGELVWVGEPLTLRTAETITGKYGVWMRDPKPTYPYTQETTWRIDTVGTDVRQVFEYDLISQFMQGYPSKVHILPRPLESTGAVVYSGSLYFRALSPELS

SEQ ID NO: 54131 - protein, 497 aa, Homo sapiens
  Payload ID: 10699
  Gene Symbol: MEF2A
  Gene Name: myocyte enhancer factor 2A
  Uniprot ID: Q02078
  ENSP ID: ENSP00000337202
MGRKKIQITRIMDERNRQVTFTKRKFGLMKKAYELSVLCDCEIALIIFNSSNKLFQYASTDMDKVLLKYTEYNEPHESRTNSDIVETLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 54132 - protein, 499 aa, Homo sapiens
  Payload ID: 10699
  Gene Symbol: MEF2A
  Gene Name: myocyte enhancer factor 2A
  Uniprot ID: Q02078
  ENSP ID: ENSP00000346389
MGRKKIQITRIMDERNRQVTFTKRKFGLMKKAYELSVLCDCEIALIIFNSSNKLFQYASTDMDKVLLKYTEYNEPHESRTNSDIVEALNKKEHRGCDSPDPDTSYVLTPHTEEKYKKINEEFDNMMRNHKIAPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 54133 - protein, 429 aa, Homo sapiens
  Payload ID: 10699
  Gene Symbol: MEF2A
  Gene Name: myocyte enhancer factor 2A
  Uniprot ID: Q02078
  ENSP ID: ENSP00000399460
MGRKKIQITRIMDERNRQTLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 54134 - protein, 77 aa, Homo sapiens
  Payload ID: 10699
  Gene Symbol: MEF2A
  Gene Name: myocyte enhancer factor 2A
  ENSP ID: ENSP00000452989
MGRKKIQITRIMDERNRQVTFTKRKFGLMKKAYELSVLCDCEIALIIFNSSNKLFQYASTDMDKVLLKYTEYNEPHE

SEQ ID NO: 54135 - protein, 505 aa, Homo sapiens
  Payload ID: 10699
  Gene Symbol: MEF2A
  Gene Name: myocyte enhancer factor 2A
  Uniprot ID: Q02078
  ENSP ID: ENSP00000453095
MGRKKIQITRIMDERNRQVTFTKRKFGLMKKAYELSVLCDCEIALIIFNSSNKLFQYASTDMDKVLLKYTEYNEPHESRTNSDIVETLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLSEEEELELNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 54136 - protein, 497 aa, Homo sapiens; identical to SEQ ID NO: 54131
  Payload ID: 10699
  Gene Symbol: MEF2A
  Gene Name: myocyte enhancer factor 2A
  Uniprot ID: Q02078
  ENSP ID: ENSP00000453441

SEQ ID NO: 54137 - protein, 85 aa, Homo sapiens
  Payload ID: 10699
  Gene Symbol: MEF2A
  Gene Name: myocyte enhancer factor 2A
  ENSP ID: ENSP00000453478
MGRKKIQITRIMDERNRQVTFTKRKFGLMKKAYELSVLCDCEIALIIFNSSNKLFQYASTDMDKVLLKYTEYNEPHESRTNSDIV

SEQ ID NO: 54138 - protein, 38 aa, Homo sapiens
  Payload ID: 10699
  Gene Symbol: MEF2A
  Gene Name: myocyte enhancer factor 2A
  ENSP ID: ENSP00000454023
MGRKKIQITRIMDERNRQVTFTKRKFGLMKKAYELSVL

SEQ ID NO: 54139 - protein, 437 aa, Homo sapiens
  Payload ID: 10699
  Gene Symbol: MEF2A
  Gene Name: myocyte enhancer factor 2A
  Uniprot ID: Q02078
  ENSP ID: ENSP00000454120
MGRKKIQITRIMDERNRQTLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLSEEEELELNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 54140 - protein, 375 aa, Homo sapiens
  Payload ID: 10700
  Gene Symbol: MEF2B
  Gene Name: myocyte enhancer factor 2B
  ENSP ID: ENSP00000386374
MGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPAPNSCPPEYGLGDPPPPPGLLQPPTLAPWQPSRGDGPPAVSSQPSGGRSLGEEGPPTRGASPPTPPVSIKSERLSPAPGGPGDFPKTFPYPLLLARSLAEPLRPGPALRRLPLADGWPR

SEQ ID NO: 54141 - protein, 297 aa, Homo sapiens
  Payload ID: 10700
  Gene Symbol: MEF2B
  Gene Name: myocyte enhancer factor 2B
  ENSP ID: ENSP00000386480
MGRKKIQISRILDQRNRQVTFTKRKFGLMKKAYELSVLCDCEIALIIFNSANRLFQYASTDMDRVLLKYTEYSEPHESRTNTDILEVPQTLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPEYGLGDPPPPPGLLQPPTLAPWQPSRGDGPPAVSSQPR

SEQ ID NO: 54142 - protein, 286 aa, Homo sapiens
  Payload ID: 10700
  Gene Symbol: MEF2B
  Gene Name: myocyte enhancer factor 2B
  ENSP ID: ENSP00000386784
MGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPEKPLQWPAEPLLHCNSRTPTGELPLPPRRPPSGGRSLGEEGPPTRGASPPTPPVSIKSERLSPAPGGPGDFPKTFPYPLLLARSLAEPLRPGPALRRLPLADGWPR

SEQ ID NO: 54143 - protein, 368 aa, Homo sapiens
  Payload ID: 10700
  Gene Symbol: MEF2B
  Gene Name: myocyte enhancer factor 2B
  Uniprot ID: Q02080
  ENSP ID: ENSP00000402154
MGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPEYGLGDPPPPPGLLQPPTLAPWQPSRGDGPPAVSSQPSGGRSLGEEGPPTRGASPPTPPVSIKSERLSPAPGGPGDFPKTFPYPLLLARSLAEPLRPGPALRRLPLADGWPR

SEQ ID NO: 54144 - protein, 483 aa, Homo sapiens
  Payload ID: 10701
  Gene Symbol: MEF2C
  Gene Name: myocyte enhancer factor 2C
  Uniprot ID: Q06413
  ENSP ID: ENSP00000340874
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54145 - protein, 463 aa, Homo sapiens
  Payload ID: 10701
  Gene Symbol: MEF2C
  Gene Name: myocyte enhancer factor 2C
  Uniprot ID: Q06413
  ENSP ID: ENSP00000389610
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54146 - protein, 473 aa, Homo sapiens
  Payload ID: 10701
  Gene Symbol: MEF2C
  Gene Name: myocyte enhancer factor 2C
  Uniprot ID: Q06413
  ENSP ID: ENSP00000396219
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54147 - protein, 473 aa, Homo sapiens; identical to SEQ ID NO: 54146
  Payload ID: 10701
  Gene Symbol: MEF2C
  Gene Name: myocyte enhancer factor 2C
  Uniprot ID: Q06413
  ENSP ID: ENSP00000421925

SEQ ID NO: 54148 - protein, 433 aa, Homo sapiens
  Payload ID: 10701
  Gene Symbol: MEF2C
  Gene Name: myocyte enhancer factor 2C
  ENSP ID: ENSP00000422390
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGDRTTTPSRYPQHTRHEAGRSPVDSLSSCSSSYDGSDREDHRNEFHSPIGLTRPSPDERESPSVKRMRLSEGWAT

SEQ ID NO: 54149 - protein, 465 aa, Homo sapiens
  Payload ID: 10701
  Gene Symbol: MEF2C
  Gene Name: myocyte enhancer factor 2C
  Uniprot ID: Q06413
  ENSP ID: ENSP00000423597
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54150 - protein, 227 aa, Homo sapiens
  Payload ID: 10701
  Gene Symbol: MEF2C
  Gene Name: myocyte enhancer factor 2C
  ENSP ID: ENSP00000423656
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSP

SEQ ID NO: 54151 - protein, 242 aa, Homo sapiens
  Payload ID: 10701
  Gene Symbol: MEF2C
  Gene Name: myocyte enhancer factor 2C
  ENSP ID: ENSP00000423826
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPM

SEQ ID NO: 54152 - protein, 120 aa, Homo sapiens
  Payload ID: 10701
  Gene Symbol: MEF2C
  Gene Name: myocyte enhancer factor 2C
  ENSP ID: ENSP00000424331
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINE

SEQ ID NO: 54153 - protein, 441 aa, Homo sapiens
  Payload ID: 10701
  Gene Symbol: MEF2C
  Gene Name: myocyte enhancer factor 2C
  Uniprot ID: Q06413
  ENSP ID: ENSP00000424606
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGDRTTTPSRYPQHTRHEAGRSPVDSLSSCSSSYDGSDREDHRNEFHSPIGLTRPSPDERESPSVKRMRLSEGWAT

SEQ ID NO: 54154 - protein, 399 aa, Homo sapiens
  Payload ID: 10701
  Gene Symbol: MEF2C
  Gene Name: myocyte enhancer factor 2C
  ENSP ID: ENSP00000425636
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGQNLFLLLETVPPPLRDTHNTRATRRGDLLLTA

SEQ ID NO: 54155 - protein, 126 aa, Homo sapiens
  Payload ID: 10701
  Gene Symbol: MEF2C
  Gene Name: myocyte enhancer factor 2C
  ENSP ID: ENSP00000426442
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDL

SEQ ID NO: 54156 - protein, 87 aa, Homo sapiens
  Payload ID: 10701
  Gene Symbol: MEF2C
  Gene Name: myocyte enhancer factor 2C
  ENSP ID: ENSP00000426465
MGRKKIQITRIMDERNRQVTFTKRKFGLMKKAYELSVLCDCEIALIIFNSTNKLFQYASTDMDKVLLKYTEYNEPHESRTNSDIVET

SEQ ID NO: 54157 - protein, 441 aa, Homo sapiens; identical to SEQ ID NO: 54153
  Payload ID: 10701
  Gene Symbol: MEF2C
  Gene Name: myocyte enhancer factor 2C
  Uniprot ID: Q06413
  ENSP ID: ENSP00000426665

SEQ ID NO: 54158 - protein, 129 aa, Homo sapiens
  Payload ID: 10701
  Gene Symbol: MEF2C
  Gene Name: myocyte enhancer factor 2C
  ENSP ID: ENSP00000427163
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMIS

SEQ ID NO: 54159 - protein, 194 aa, Homo sapiens
  Payload ID: 10701
  Gene Symbol: MEF2C
  Gene Name: myocyte enhancer factor 2C
  ENSP ID: ENSP00000427286
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAG

SEQ ID NO: 54160 - protein, 28 aa, Homo sapiens
  Payload ID: 10701
  Gene Symbol: MEF2C
  Gene Name: myocyte enhancer factor 2C
  ENSP ID: ENSP00000427309
MGRKKIQITRIMDERNRQVTFTKRKFGL

SEQ ID NO: 54161 - protein, 205 aa, Homo sapiens
  Payload ID: 10701
  Gene Symbol: MEF2C
  Gene Name: myocyte enhancer factor 2C
  ENSP ID: ENSP00000485972
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSG

SEQ ID NO: 54162 - protein, 431 aa, Homo sapiens
  Payload ID: 10701
  Gene Symbol: MEF2C
  Gene Name: myocyte enhancer factor 2C
  ENSP ID: ENSP00000486490
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGDRTTTPSRYPQHTRHEAGRSPVDSLSSCSSSYDGSDREDHRNEFHSPIGLTRPSPDERESPSVKRMRLSEGWAT

SEQ ID NO: 54163 - protein, 465 aa, Homo sapiens; identical to SEQ ID NO: 54149
  Payload ID: 10701
  Gene Symbol: MEF2C
  Gene Name: myocyte enhancer factor 2C
  Uniprot ID: Q06413
  ENSP ID: ENSP00000486554

SEQ ID NO: 54164 - protein, 183 aa, Homo sapiens
  Payload ID: 10701
  Gene Symbol: MEF2C
  Gene Name: myocyte enhancer factor 2C
  ENSP ID: ENSP00000486932
GLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGPYHHPFEIPTTHAPRGGEISC

SEQ ID NO: 54165 - protein, 151 aa, Homo sapiens
  Payload ID: 10701
  Gene Symbol: MEF2C
  Gene Name: myocyte enhancer factor 2C
  ENSP ID: ENSP00000487157
AKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGPYHHPFEIPTTHAPRGGEISC

SEQ ID NO: 54166 - protein, 393 aa, Homo sapiens
  Payload ID: 10701
  Gene Symbol: MEF2C
  Gene Name: myocyte enhancer factor 2C
  ENSP ID: ENSP00000487184
MGRKKIQITRIMDERNRQVTFTKRKFGLMKKAYELSVLCDCEIALIIFNSTNKLFQYASTDMDKVLLKYTEYNEPHESRTNSDIVEAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGDRTTTPSRYPQHTRHEAGRSPVDSLSSCSSSYDGSDREDHRNEFHSPIGLTRPSPDERESPSVKRMRLSEGWAT

SEQ ID NO: 54167 - protein, 417 aa, Homo sapiens
  Payload ID: 10701
  Gene Symbol: MEF2C
  Gene Name: myocyte enhancer factor 2C
  Uniprot ID: Q06413
  ENSP ID: ENSP00000487311
MGRKKIQITRIMDERNRQVTFTKRKFGLMKKAYELSVLCDCEIALIIFNSTNKLFQYASTDMDKVLLKYTEYNEPHESRTNSDIVEAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54168 - protein, 463 aa, Homo sapiens; identical to SEQ ID NO: 54145
  Payload ID: 10701
  Gene Symbol: MEF2C
  Gene Name: myocyte enhancer factor 2C
  Uniprot ID: Q06413
  ENSP ID: ENSP00000487430

SEQ ID NO: 54169 - protein, 102 aa, Homo sapiens
  Payload ID: 10701
  Gene Symbol: MEF2C
  Gene Name: myocyte enhancer factor 2C
  ENSP ID: ENSP00000487437
MISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVS

SEQ ID NO: 54170 - protein, 471 aa, Homo sapiens
  Payload ID: 10701
  Gene Symbol: MEF2C
  Gene Name: myocyte enhancer factor 2C
  ENSP ID: ENSP00000487538
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54171 - protein, 521 aa, Homo sapiens
  Payload ID: 10702
  Gene Symbol: MEF2D
  Gene Name: myocyte enhancer factor 2D
  Uniprot ID: Q14814
  ENSP ID: ENSP00000271555
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 54172 - protein, 514 aa, Homo sapiens
  Payload ID: 10702
  Gene Symbol: MEF2D
  Gene Name: myocyte enhancer factor 2D
  Uniprot ID: Q14814
  ENSP ID: ENSP00000353803
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 54173 - protein, 139 aa, Homo sapiens
  Payload ID: 10702
  Gene Symbol: MEF2D
  Gene Name: myocyte enhancer factor 2D
  ENSP ID: ENSP00000357223
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGGPCWGVT

SEQ ID NO: 54174 - protein, 513 aa, Homo sapiens
  Payload ID: 10702
  Gene Symbol: MEF2D
  Gene Name: myocyte enhancer factor 2D
  Uniprot ID: Q14814
  ENSP ID: ENSP00000476788
MGRKKIQIQRITDERNRQVTFTKRKFGLMKKAYELSVLCDCEIALIIFNHSNKLFQYASTDMDKVLLKYTEYNEPHESRTNADIIEALHKKHRECESPEVDEVFALTPQTEEKYKKIDEEFDKMMQSYRLASTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 54175 - protein, 10 aa, Homo sapiens
  Payload ID: 10702
  Gene Symbol: MEF2D
  Gene Name: myocyte enhancer factor 2D
  ENSP ID: ENSP00000477124
MGRKKIQIQR

SEQ ID NO: 54176 - protein, 139 aa, Homo sapiens; identical to SEQ ID NO: 54173
  Payload ID: 10702
  Gene Symbol: MEF2D
  Gene Name: myocyte enhancer factor 2D
  ENSP ID: ENSP00000477413

SEQ ID NO: 54177 - protein, 246 aa, Homo sapiens
  Payload ID: 10703
  Gene Symbol: MDFI
  Gene Name: MyoD family inhibitor
  Uniprot ID: Q99750
  ENSP ID: ENSP00000230321
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCDLPCDLDCGILDACCESADCLEICMECCGLCFSS

SEQ ID NO: 54178 - protein, 185 aa, Homo sapiens
  Payload ID: 10703
  Gene Symbol: MDFI
  Gene Name: MyoD family inhibitor
  ENSP ID: ENSP00000362141
MYQVSGQRPSGCDAPYGAPSAAPGPGQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCDLPCDLDCGILDACCESADCLEICMECCGLCFSS

SEQ ID NO: 54179 - protein, 246 aa, Homo sapiens; identical to SEQ ID NO: 54177
  Payload ID: 10703
  Gene Symbol: MDFI
  Gene Name: MyoD family inhibitor
  Uniprot ID: Q99750
  ENSP ID: ENSP00000362142

SEQ ID NO: 54180 - protein, 231 aa, Homo sapiens
  Payload ID: 10703
  Gene Symbol: MDFI
  Gene Name: MyoD family inhibitor
  ENSP ID: ENSP00000393881
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCDLPCDLDCGILDACCESAD

SEQ ID NO: 54181 - protein, 142 aa, Homo sapiens
  Payload ID: 10703
  Gene Symbol: MDFI
  Gene Name: MyoD family inhibitor
  ENSP ID: ENSP00000403587
MYQVSGQRPSGCDAPYGAPSAAPGPGQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCC

SEQ ID NO: 54182 - protein, 98 aa, Homo sapiens
  Payload ID: 10703
  Gene Symbol: MDFI
  Gene Name: MyoD family inhibitor
  ENSP ID: ENSP00000406600
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTP

SEQ ID NO: 54183 - protein, 128 aa, Homo sapiens
  Payload ID: 10703
  Gene Symbol: MDFI
  Gene Name: MyoD family inhibitor
  ENSP ID: ENSP00000411829
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHR

SEQ ID NO: 54184 - protein, 213 aa, Homo sapiens
  Payload ID: 10703
  Gene Symbol: MDFI
  Gene Name: MyoD family inhibitor
  ENSP ID: ENSP00000413226
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCD

SEQ ID NO: 54185 - protein, 355 aa, Homo sapiens
  Payload ID: 10704
  Gene Symbol: MDFIC
  Gene Name: MyoD family inhibitor domain containing
  ENSP ID: ENSP00000257724
VRGVRAATAAAVAATAASGLSRREAGGRAGAAAAVVRPPGRKCGRCRRLANFPGRKRRRRRRKGLGATTGGCGEAVSSLHPAPHSPSSVRPAGRRARRQRRGAGSAERPMSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQASCGICTSEACCCCCGDEMGDDCNCPCDMDCGIMDACCESSDCLEICMECCGICFPS

SEQ ID NO: 54186 - protein, 246 aa, Homo sapiens
  Payload ID: 10704
  Gene Symbol: MDFIC
  Gene Name: MyoD family inhibitor domain containing
  Uniprot ID: Q9P1T7
  ENSP ID: ENSP00000377126
MSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQASCGICTSEACCCCCGDEMGDDCNCPCDMDCGIMDACCESSDCLEICMECCGICFPS

SEQ ID NO: 54187 - protein, 156 aa, Homo sapiens
  Payload ID: 10704
  Gene Symbol: MDFIC
  Gene Name: MyoD family inhibitor domain containing
  ENSP ID: ENSP00000392098
PQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDKQEFW

SEQ ID NO: 54188 - protein, 43 aa, Homo sapiens
  Payload ID: 10704
  Gene Symbol: MDFIC
  Gene Name: MyoD family inhibitor domain containing
  ENSP ID: ENSP00000401623
MSGAGEALAPGPVGPQRVAEAGGGQLGSTAQGLFSRSRTAAAL

SEQ ID NO: 54189 - protein, 43 aa, Homo sapiens; identical to SEQ ID NO: 54188
  Payload ID: 10704
  Gene Symbol: MDFIC
  Gene Name: MyoD family inhibitor domain containing
  ENSP ID: ENSP00000412153

SEQ ID NO: 54190 - protein, 156 aa, Homo sapiens
  Payload ID: 10704
  Gene Symbol: MDFIC
  Gene Name: MyoD family inhibitor domain containing
  ENSP ID: ENSP00000416668
GPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEVC

SEQ ID NO: 54191 - protein, 135 aa, Homo sapiens
  Payload ID: 10704
  Gene Symbol: MDFIC
  Gene Name: MyoD family inhibitor domain containing
  ENSP ID: ENSP00000418337
MQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQA

SEQ ID NO: 54192 - protein, 355 aa, Homo sapiens; identical to SEQ ID NO: 54185
  Payload ID: 10704
  Gene Symbol: MDFIC
  Gene Name: MyoD family inhibitor domain containing
  ENSP ID: ENSP00000484656

SEQ ID NO: 54193 - protein, 2048 aa, Homo sapiens
  Payload ID: 10705
  Gene Symbol: MYOF
  Gene Name: myoferlin
  Uniprot ID: Q9NZM1
  ENSP ID: ENSP00000351094
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 54194 - protein, 2061 aa, Homo sapiens
  Payload ID: 10705
  Gene Symbol: MYOF
  Gene Name: myoferlin
  Uniprot ID: Q9NZM1
  ENSP ID: ENSP00000352208
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 54195 - protein, 160 aa, Homo sapiens
  Payload ID: 10705
  Gene Symbol: MYOF
  Gene Name: myoferlin
  Uniprot ID: Q9NZM1
  ENSP ID: ENSP00000360543
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGKLTLLKAQPPPGGGC

SEQ ID NO: 54196 - protein, 445 aa, Homo sapiens
  Payload ID: 10705
  Gene Symbol: MYOF
  Gene Name: myoferlin
  Uniprot ID: Q9NZM1
  ENSP ID: ENSP00000360544
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDW

SEQ ID NO: 54197 - protein, 1177 aa, Homo sapiens
  Payload ID: 10705
  Gene Symbol: MYOF
  Gene Name: myoferlin
  ENSP ID: ENSP00000432708
  MOD_RES (1)..(1): Any amino acid
XNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKCLSSMSTALSKMASPATVHLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQILPACDHLEHQGRYLGREKHHRRGNE

SEQ ID NO: 54198 - protein, 320 aa, Homo sapiens
  Payload ID: 10706
  Gene Symbol: MYOD1
  Gene Name: myogenic differentiation 1
  Uniprot ID: P15172
  ENSP ID: ENSP00000250003
MELLSPPLRDVDLTAPDGSLCSFATTDDFYDDPCFDSPDLRFFEDLDPRLMHVGALLKPEEHSHFPAAVHPAPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAAFYAPGPLPPGRGGEHYSGDSDASSPRSNCSDGMMDYSGPPSGARRRNCYEGAYYNEAPSEPRPGKSAAVSSLDCLSSIVERISTESPAAPALLLADVPSESPPRRQEAAAPSEGESSGDPTQSPDAAPQCPAGANPNPIYQVL

SEQ ID NO: 54199 - protein, 255 aa, Homo sapiens
  Payload ID: 10707
  Gene Symbol: MYF5
  Gene Name: myogenic factor 5
  Uniprot ID: P13349
  ENSP ID: ENSP00000228644
MDVMDGCQFSPSEYFYDGSCIPSPEGEFGDEFVPRVAAFGAHKAELQGSDEDEHVRAPTGHHQAGHCLMWACKACKRKSTTMDRRKAATMRERRRLKKVNQAFETLKRCTTTNPNQRLPKVEILRNAIRYIESLQELLREQVENYYSLPGQSCSEPTSPTSNCSDGMPECNSPVWSRKSSTFDSIYCPDVSNVYATDKNSLSSLDCLSNIVDRITSSEQPGLPLQDLASLSPVASTDSQPATPGASSSRLIYHVL

SEQ ID NO: 54200 - protein, 242 aa, Homo sapiens
  Payload ID: 10708
  Gene Symbol: MYF6
  Gene Name: myogenic factor 6 (herculin)
  Uniprot ID: P23409
  ENSP ID: ENSP00000228641
MMMDLFETGSYFFYLDGENVTLQPLEVAEGSPLYPGSDGTLSPCQDQMPPEAGSDSSGEEHVLAPPGLQPPHCPGQCLIWACKTCKRKSAPTDRRKAATLRERRRLKKINEAFEALKRRTVANPNQRLPKVEILRSAISYIERLQDLLHRLDQQEKMQELGVDPFSYRPKQENLEGADFLRTCSSQWPSVSDHSRGLVITAKEGGASIDSSASSSLRCLSSIVDSISSEERKLPCVEEVVEK

SEQ ID NO: 54201 - protein, 224 aa, Homo sapiens
  Payload ID: 10709
  Gene Symbol: MYOG
  Gene Name: myogenin (myogenic factor 4)
  Uniprot ID: P15173
  ENSP ID: ENSP00000241651
MELYETSPYFYQEPRFYDGENYLPVHLQGFEPPGYERTELTLSPEAPGPLEDKGLGTPEHCPGQCLPWACKVCKRKSVSVDRRRAATLREKRRLKKVNEAFEALKRSTLLNPNQRLPKVEILRSAIQYIERLQALLSSLNQEERDLRYRGGGGPQPGVPSECSSHSASCSPEWGSALEFSANPGDHLLTADPTDAHNLHSLTSIVDSITVEDVSVAFPDETMPN

SEQ ID NO: 54202 - protein, 154 aa, Homo sapiens
  Payload ID: 10710
  Gene Symbol: MB
  Gene Name: myoglobin
  Uniprot ID: P02144
  ENSP ID: ENSP00000352835
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 54203 - protein, 154 aa, Homo sapiens; identical to SEQ ID NO: 54202
  Payload ID: 10710
  Gene Symbol: MB
  Gene Name: myoglobin
  Uniprot ID: P02144
  ENSP ID: ENSP00000380489

SEQ ID NO: 54204 - protein, 154 aa, Homo sapiens; identical to SEQ ID NO: 54202
  Payload ID: 10710
  Gene Symbol: MB
  Gene Name: myoglobin
  Uniprot ID: P02144
  ENSP ID: ENSP00000380491

SEQ ID NO: 54205 - protein, 154 aa, Homo sapiens; identical to SEQ ID NO: 54202
  Payload ID: 10710
  Gene Symbol: MB
  Gene Name: myoglobin
  Uniprot ID: P02144
  ENSP ID: ENSP00000384239

SEQ ID NO: 54206 - protein, 99 aa, Homo sapiens
  Payload ID: 10710
  Gene Symbol: MB
  Gene Name: myoglobin
  ENSP ID: ENSP00000386060
MKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 54207 - protein, 106 aa, Homo sapiens
  Payload ID: 10710
  Gene Symbol: MB
  Gene Name: myoglobin
  ENSP ID: ENSP00000389263
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLE

SEQ ID NO: 54208 - protein, 106 aa, Homo sapiens; identical to SEQ ID NO: 54207
  Payload ID: 10710
  Gene Symbol: MB
  Gene Name: myoglobin
  ENSP ID: ENSP00000397944

SEQ ID NO: 54209 - protein, 143 aa, Homo sapiens
  Payload ID: 10710
  Gene Symbol: MB
  Gene Name: myoglobin
  ENSP ID: ENSP00000403351
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDM

SEQ ID NO: 54210 - protein, 74 aa, Homo sapiens
  Payload ID: 10710
  Gene Symbol: MB
  Gene Name: myoglobin
  ENSP ID: ENSP00000413309
MKASEDLKKHGATVLTALGGILKKKGHHEAEIKPLAQSHATKHKIPVKYLEFISECIIQVLQSKHPGDFGADAQ

SEQ ID NO: 54211 - protein, 77 aa, Homo sapiens
  Payload ID: 10710
  Gene Symbol: MB
  Gene Name: myoglobin
  ENSP ID: ENSP00000414243
MGLSDGEWQLVLNVWGKVEADIPGHGQEVLIRLFKGHPETLEKFDKFKHLKSEDEMKASEDLKKHGATVLTALGGIL

SEQ ID NO: 54212 - protein, 285 aa, Homo sapiens
  Payload ID: 10711
  Gene Symbol: MIOX
  Gene Name: myo-inositol oxygenase
  Uniprot ID: Q9UGB7
  ENSP ID: ENSP00000216075
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWVREFNKFDLYTKCPDLPDVDKLRPYYQGLIDKYCPGILSW

SEQ ID NO: 54213 - protein, 270 aa, Homo sapiens
  Payload ID: 10711
  Gene Symbol: MIOX
  Gene Name: myo-inositol oxygenase
  ENSP ID: ENSP00000379081
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQWAVVGDTFPVGCRPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWQVRPLHQVPGPAGRGQAAALLPGAH

SEQ ID NO: 54214 - protein, 231 aa, Homo sapiens
  Payload ID: 10711
  Gene Symbol: MIOX
  Gene Name: myo-inositol oxygenase
  Uniprot ID: Q9UGB7
  ENSP ID: ENSP00000379082
MKVTVGPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKVPNLPCPSPSQTGSTSSGSCTTWGRSWPCSGSPSGLSSATPSPSDAVRRPPWFSATPPSRTTLTSRILDTAQSSGCISPTVGSTGSSCPGAMMQVRPLHQVPGPAGRGQAAALLPGAH

SEQ ID NO: 54215 - protein, 265 aa, Homo sapiens
  Payload ID: 10711
  Gene Symbol: MIOX
  Gene Name: myo-inositol oxygenase
  ENSP ID: ENSP00000409894
GPDPSLVYRPDVDPEVAKDKASFRNYTSGPLLDRVFTTYKLMHTHQTVDFVRSKHAQFGGFSYKKMTVMEAVDLLDGLVDESDPDVDFPNSFHAFQTAEGIRKAHPDKDWFHLVGLLHDLGKVLALFGEPQASVVFCDSTFQDNPDLQDPRYSTELGMYQPHCGLDRVLMSWGHDEYMYQVMKFNKFSLPPEAFYMIRFHSFYPWHTGRDYQQLCSQQDLAMLPWVREFNKFDLYTKCPDLPDVDKLRPYYQGLIDKYCPGILSW

SEQ ID NO: 54216 - protein, 1589 aa, Homo sapiens
  Payload ID: 10712
  Gene Symbol: MYOM1
  Gene Name: myomesin 1
  Uniprot ID: P52179
  ENSP ID: ENSP00000261606
MSLPFYQRCHQHYDLSYRNKDVRSTVSHYQREKKRSAVYTQGSTAYSSRSSAAHRRESEAFRRASASSSQQQASQHALSSEVSRKAASAYDYGSSHGLTDSSLLLDDYSSKLSPKPKRAKHSLLSGEEKENLPSDYMVPIFSGRQKHVSGITDTEEERIKEAAAYIAQRNLLASEEGITTSKQSTASKQTTASKQSTASKQSTASKQSTASRQSTASRQSVVSKQATSALQQEETSEKKSRKVVIREKAERLSLRKTLEETETYHAKLNEDHLLHAPEFIIKPRSHTVWEKENVKLHCSIAGWPEPRVTWYKNQVPINVHANPGKYIIESRYGMHTLEINGCDFEDTAQYRASAMNVKGELSAYASVVVKRYKGEFDETRFHAGASTMPLSFGVTPYGYASRFEIHFDDKFDVSFGREGETMSLGCRVVITPEIKHFQPEIQWYRNGVPLSPSKWVQTLWSGERATLTFSHLNKEDEGLYTIRVRMGEYYEQYSAYVFVRDADAEIEGAPAAPLDVKCLEANKDYIIISWKQPAVDGGSPILGYFIDKCEVGTDSWSQCNDTPVKFARFPVTGLIEGRSYIFRVRAVNKMGIGFPSRVSEPVAALDPAEKARLKSRPSAPWTGQIIVTEEEPSEGIVPGPPTDLSVTEATRSYVVLSWKPPGQRGHEGIMYFVEKCEAGTENWQRVNTELPVKSPRFALFDLAEGKSYCFRVRCSNSAGVGEPSEATEVTVVGDKLDIPKAPGKIIPSRNTDTSVVVSWEESKDAKELVGYYIEASVAGSGKWEPCNNNPVKGSRFTCHGLVTGQSYIFRVRAVNAAGLSEYSQDSEAIEVKAAIAPPSPPCDITCLESFRDSMVLGWKQPDKIGGAEITGYYVNYREVIDGVPGKWREANVKAVSEEAYKISNLKENMVYQFQVAAMNMAGLGAPSAVSECFKCEEWTIAVPGPPHSLKCSEVRKDSLVLQWKPPVHSGRTPVTGYFVDLKEAKAKEDQWRGLNEAAIKNVYLKVRGLKEGVSYVFRVRAINQAGVGKPSDLAGPVVAETRPGTKEVVVNVDDDGVISLNFECDKMTPKSEFSWSKDYVSTEDSPRLEVESKGNKTKMTFKDLGMDDLGIYSCDVTDTDGIASSYLIDEEELKRLLALSHEHKFPTVPVKSELAVEILEKGQVRFWMQAEKLSGNAKVNYIFNEKEIFEGPKYKMHIDRNTGIIEMFMEKLQDEDEGTYTFQLQDGKATNHSTVVLVGDVFKKLQKEAEFQRQEWIRKQGPHFVEYLSWEVTGECNVLLKCKVANIKKETHIVWYKDEREISVDEKHDFKDGICTLLITEFSKKDAGIYEVILKDDRGKDKSRLKLVDEAFKELMMEVCKKIALSATDLKIQSTAEGIQLYSFVTYYVEDLKVNWSHNGSAIRYSDRVKTGVTGEQIWLQINEPTPNDKGKYVMELFDGKTGHQKTVDLSGQAYDEAYAEFQRLKQAAIAEKNRARVLGGLPDVVTIQEGKALNLTCNVWGDPPPEVSWLKNEKALASDDHCNLKFEAGRTAYFTINGVSTADSGKYGLVVKNKYGSETSDFTVSVFIPEEEARMAALESLKGGKKAK

SEQ ID NO: 54217 - protein, 1685 aa, Homo sapiens
  Payload ID: 10712
  Gene Symbol: MYOM1
  Gene Name: myomesin 1
  Uniprot ID: P52179
  ENSP ID: ENSP00000348821
MSLPFYQRCHQHYDLSYRNKDVRSTVSHYQREKKRSAVYTQGSTAYSSRSSAAHRRESEAFRRASASSSQQQASQHALSSEVSRKAASAYDYGSSHGLTDSSLLLDDYSSKLSPKPKRAKHSLLSGEEKENLPSDYMVPIFSGRQKHVSGITDTEEERIKEAAAYIAQRNLLASEEGITTSKQSTASKQTTASKQSTASKQSTASKQSTASRQSTASRQSVVSKQATSALQQEETSEKKSRKVVIREKAERLSLRKTLEETETYHAKLNEDHLLHAPEFIIKPRSHTVWEKENVKLHCSIAGWPEPRVTWYKNQVPINVHANPGKYIIESRYGMHTLEINGCDFEDTAQYRASAMNVKGELSAYASVVVKRYKGEFDETRFHAGASTMPLSFGVTPYGYASRFEIHFDDKFDVSFGREGETMSLGCRVVITPEIKHFQPEIQWYRNGVPLSPSKWVQTLWSGERATLTFSHLNKEDEGLYTIRVRMGEYYEQYSAYVFVRDADAEIEGAPAAPLDVKCLEANKDYIIISWKQPAVDGGSPILGYFIDKCEVGTDSWSQCNDTPVKFARFPVTGLIEGRSYIFRVRAVNKMGIGFPSRVSEPVAALDPAEKARLKSRPSAPWTGQIIVTEEEPSEGIVPGPPTDLSVTEATRSYVVLSWKPPGQRGHEGIMYFVEKCEAGTENWQRVNTELPVKSPRFALFDLAEGKSYCFRVRCSNSAGVGEPSEATEVTVVGDKLDIPKAPGKIIPSRNTDTSVVVSWEESKDAKELVGYYIEASVAGSGKWEPCNNNPVKGSRFTCHGLVTGQSYIFRVRAVNAAGLSEYSQDSEAIEVKAAIGGGVSPDVCPALSDEPGGLTASRGRVHEASPPTFQKDALLGSKPNKPSLPSSSQNLGQTEVSKVSETVQEELTPPPQKAAPQGKSKSDPLKKKTDRAPPSPPCDITCLESFRDSMVLGWKQPDKIGGAEITGYYVNYREVIDGVPGKWREANVKAVSEEAYKISNLKENMVYQFQVAAMNMAGLGAPSAVSECFKCEEWTIAVPGPPHSLKCSEVRKDSLVLQWKPPVHSGRTPVTGYFVDLKEAKAKEDQWRGLNEAAIKNVYLKVRGLKEGVSYVFRVRAINQAGVGKPSDLAGPVVAETRPGTKEVVVNVDDDGVISLNFECDKMTPKSEFSWSKDYVSTEDSPRLEVESKGNKTKMTFKDLGMDDLGIYSCDVTDTDGIASSYLIDEEELKRLLALSHEHKFPTVPVKSELAVEILEKGQVRFWMQAEKLSGNAKVNYIFNEKEIFEGPKYKMHIDRNTGIIEMFMEKLQDEDEGTYTFQLQDGKATNHSTVVLVGDVFKKLQKEAEFQRQEWIRKQGPHFVEYLSWEVTGECNVLLKCKVANIKKETHIVWYKDEREISVDEKHDFKDGICTLLITEFSKKDAGIYEVILKDDRGKDKSRLKLVDEAFKELMMEVCKKIALSATDLKIQSTAEGIQLYSFVTYYVEDLKVNWSHNGSAIRYSDRVKTGVTGEQIWLQINEPTPNDKGKYVMELFDGKTGHQKTVDLSGQAYDEAYAEFQRLKQAAIAEKNRARVLGGLPDVVTIQEGKALNLTCNVWGDPPPEVSWLKNEKALASDDHCNLKFEAGRTAYFTINGVSTADSGKYGLVVKNKYGSETSDFTVSVFIPEEEARMAALESLKGGKKAK

SEQ ID NO: 54218 - protein, 1452 aa, Homo sapiens
  Payload ID: 10712
  Gene Symbol: MYOM1
  Gene Name: myomesin 1
  ENSP ID: ENSP00000383413
MVPIFSGRQKHVSGITDTEEERIKEAAAYIAQRNLLASEEGITTSKQSTASKQTTASKQSTASKQSTASKQSTASRQSTASRQSVVSKQATSALQQEETSEKKSRKVVIREKAERLSLRKTLEETETYHAKLNEDHLLHAPEFIIKPRSHTVWEKENVKLHCSIAGWPEPRVTWYKNQVPINVHANPGKYIIESRYGMHTLEINGCDFEDTAQYRASAMNVKGELSAYASVVVKRYKGEFDETRFHAGASTMPLSFGVTPYGYASRFEIHFDDKFDVSFGREGETMSLGCRVVITPEIKHFQPEIQWYRNGVPLSPSKWVQTLWSGERATLTFSHLNKEDEGLYTIRVRMGEYYEQYSAYVFVRDADAEIEGAPAAPLDVKCLEANKDYIIISWKQPAVDGGSPILGYFIDKCEVGTDSWSQCNDTPVKFARFPVTGLIEGRSYIFRVRAVNKMGIGFPSRVSEPVAALDPAEKARLKSPLSTLDWTIIVTEEEPSEGIVPGPPTDLSVTEATRSYVVLSWKPPGQRGHEGIMYFVEKCEAGTENWQRVNTELPVKSPRFALFDLAEGKSYCFRVRCSNSAGVGEPSEATEVTVVGDKLDIPKAPGKIIPSRNTDTSVVVSWEESKDAKELVGYYIEASVAGSGKWEPCNNNPVKAHGFTCHGLVTGQSYIFRVRAVNAAGLSEYSQDSEAIEVKAAIAPPSPPCDITCLESFRDSMVLGWKQPDKIGGAEITGYYVNYREVIDGVPGKWREANVKAVSEEAYKISNLKENMVYQFQVAAMNMAGLGAPSAVSECFKCEEWTIAVPGPPHSLKCSEVRKDSLVLQWKPPVHSGRTPVTGYFVDLKEAKAKEDQWRGLNEAAIKNVYLKVRGLKEGVSYVFRVRAINQAGVGKPSDLAGPVVAETRPGTKEVVVNVDDDGVISLNFECDKMTPKSEFSWSKDYVSTEDSPRLEVESKGNKTKMTFKDLGMDDLGIYSCDVTDTDGIASSYLIDEEELKRLLALSHEHKFPTVPVKSELAVEILEKGQVRFWMQAEKLSGNAKVNYIFNEKEIFEGPKYKMHIDRNTGIIEMFMEKLQDEDEGTYTFQLQDGKATNHSTVVLVGDVFKKLQKEAEFQRQEWIRKQGPHFVEYLSWEVTGECNVLLKCKVANIKKETHIVWYKDEREISVDEKHDFKDGICTLLITEFSKKDAGIYEVILKDDRGKDKSRLKLVDEAFKELMMEVCKKIALSATDLKIQSTAEGIQLYSFVTYYVEDLKVNWSHNGSAIRYSDRVKTGVTGEQIWLQINEPTPNDKGKYVMELFDGKTGHQKTVDLSGQAYDEAYAEFQRLKQAAIAEKNRARVLGGLPDVVTIQEGKALNLTCNVWGDPPPEVSWLKNEKALASDDHCNLKFEAGRTAYFTINGVSTADSGKYGLVVKNKYGSETSDFTVSVFIPEEEARMAALESLKGGKKAK

SEQ ID NO: 54219 - protein, 121 aa, Homo sapiens
  Payload ID: 10712
  Gene Symbol: MYOM1
  Gene Name: myomesin 1
  ENSP ID: ENSP00000462039
IEMFMEKLQDEDEGTYTFQLQDGKATNHSTVVLVGDVFKKLQKEAEFQRQEWIRKQGPHFVEYLSWEVTGECNVLLKCKVANIKKETHIVWYKDEREISVDEKHDFKDGICTLLITEPLRN

SEQ ID NO: 54220 - protein, 1465 aa, Homo sapiens
  Payload ID: 10713
  Gene Symbol: MYOM2
  Gene Name: myomesin 2
  Uniprot ID: P54296
  ENSP ID: ENSP00000262113
MSLVTVPFYQKRHRHFDQSYRNIQTRYLLDEYASKKRASTQASSQKSLSQRSSSQRASSQTSLGGTICRVCAKRVSTQEDEEQENRSRYQSLVAAYGEAKRQRFLSELAHLEEDVHLARSQARDKLDKYAIQQMMEDKLAWERHTFEERISRAPEILVRLRSHTVWERMSVKLCFTVQGFPTPVVQWYKDGSLICQAAEPGKYRIESNYGVHTLEINRADFDDTATYSAVATNAHGQVSTNAAVVVRRFRGDEEPFRSVGLPIGLPLSSMIPYTHFDVQFLEKFGVTFRREGETVTLKCTMLVTPDLKRVQPRAEWYRDDVLLKESKWTKMFFGEGQASLSFSHLHKDDEGLYTLRIVSRGGVSDHSAFLFVRDADPLVTGAPGAPMDLQCHDANRDYVIVTWKPPNTTTESPVMGYFVDRCEVGTNNWVQCNDAPVKICKYPVTGLFEGRSYIFRVRAVNSAGISRPSRVSDAVAALDPLDLRRLQAVHLEGEKEIAIYQDDLEGDAQVPGPPTGVHASEISRNYVVLSWEPPTPRGKDPLMYFIEKSVVGSGSWQRVNAQTAVRSPRYAVFDLMEGKSYVFRVLSANRHGLSEPSEITSPIQAQDVTVVPSAPGRVLASRNTKTSVVVQWDRPKHEEDLLGYYVDCCVAGTNLWEPCNHKPIGYNRFVVHGLTTGEQYIFRVKAVNAVGMSENSQESDVIKVQAALTVPSHPYGITLLNCDGHSMTLGWKVPKFSGGSPILGYYLDKREVHHKNWHEVNSSPSKPTILTVDGLTEGSLYEFKIAAVNLAGIGEPSDPSEHFKCEAWTMPEPGPAYDLTFCEVRDTSLVMLWKAPVYSGSSPVSGYFVDFREEDAGEWITVNQTTTASRYLKVSDLQQGKTYVFRVRAVNANGVGKPSDTSEPVLVEARPGTKEISAGVDEQGNIYLGFDCQEMTDASQFTWCKSYEEISDDERFKIETVGDHSKLYLKNPDKEDLGTYSVSVSDTDGVSSSFVLDPEELERLMALSNEIKNPTIPLKSELAYEIFDKGRVRFWLQAEHLSPDASYRFIINDREVSDSEIHRIKCDKATGIIEMVMDRFSIENEGTYTVQIHDGKAKSQSSLVLIGDAFKTVLEEAEFQRKEFLRKQGPHFAEYLHWDVTEECEVRLVCKVANTKKETVFKWLKDDVLYETETLPNLERGICELLIPKLSKKDHGEYKATLKDDRGQDVSILEIAGKVYDDMILAMSRVCGKSASPLKVLCTPEGIRLQCFMKYFTDEMKVNWCHKDAKISSSEHMRIGGSEEMAWLQICEPTEKDKGKYTFEIFDGKDNHQRSLDLSGQAFDEAFAEFQQFKAAAFAEKNRGRLIGGLPDVVTIMEGKTLNLTCTVFGNPDPEVIWFKNDQDIQLSEHFSVKVEQAKYVSMTIKGVTSEDSGKYSINIKNKYGGEKIDVTVSVYKHGEKIPDMAPPQQAKPKLIPASASAAGQ

SEQ ID NO: 54221 - protein, 890 aa, Homo sapiens
  Payload ID: 10713
  Gene Symbol: MYOM2
  Gene Name: myomesin 2
  ENSP ID: ENSP00000428396
MEGKSYVFRVLSANRHGLSEPSEITSPIQAQDVTVVPSAPGRVLASRNTKTSVVVQWDRPKHEEDLLGYYVDCCVAGTNLWEPCNHKPIGYNRFVVHGLTTGEQYIFRVKAVNAVGMSENSQESDVIKVQAALTVPSHPYGITLLNCDGHSMTLGWKVPKFSGGSPILGYYLDKREVHHKNWHEVNSSPSKPTILTVDGLTEGSLYEFKIAAVNLAGIGEPSDPSEHFKCEAWTMPEPGPAYDLTFCEVRDTSLVMLWKAPVYSGSSPVSGYFVDFREEDAGEWITVNQTTTASRYLKVSDLQQGKTYVFRVRAVNANGVGKPSDTSEPVLVEARPGTKEISAGVDEQGNIYLGFDCQEMTDASQFTWCKSYEEISDDERFKIETVGDHSKLYLKNPDKEDLGTYSVSVSDTDGVSSSFVLDPEELERLMALSNEIKNPTIPLKSELAYEIFDKGRVRFWLQAEHLSPDASYRFIINDREVSDSEIHRIKCDKATGIIEMVMDRFSIENEGTYTVQIHDGKAKSQSSLVLIGDAFKTVLEEAEFQRKEFLRKQGPHFAEYLHWDVTEECEVRLVCKVANTKKETVFKWLKDDVLYETETLPNLERGICELLIPKLSKKDHGEYKATLKDDRGQDVSILEIAGKVYDDMILAMSRVCGKSASPLKVLCTPEGIRLQCFMKYFTDEMKVNWCHKDAKISSSEHMRIGGSEEMAWLQICEPTEKDKGKYTFEIFDGKDNHQRSLDLSGQAFDEAFAEFQQFKAAAFAEKNRGRLIGGLPDVVTIMEGKTLNLTCTVFGNPDPEVIWFKNDQDIQLSEHFSVKVEQAKYVSMTIKGVTSEDSGKYSINIKNKYGGEKIDVTVSVYKHGEKIPDMAPPQQAKPKLIPASASAAGQ

SEQ ID NO: 54222 - protein, 1465 aa, Homo sapiens
  Payload ID: 10713
  Gene Symbol: MYOM2
  Gene Name: myomesin 2
  Uniprot ID: P54296
  ENSP ID: ENSP00000478322
MSLVTVPFYQKRHRHFDQSYRNIQTRYLLDEYASKKRASTQASSQKSLSQRSSSQRASSQTSLGGTICRVCAKRVSTQEDEEQENRSRYQSLVAAYGEAKRQRFLSELAHLEEDVHLARSQARDKLDKYAIQQMMEDKLAWERHTFEERISRAPEILVRLRSHTVWERMSVKLCFTVQGFPTPVVQWYKDGSLICQAAEPGKYRIESNYGVHTLEINRADFDDTATYSAVATNAHGQVSTNAAVVVRRFRGDEEPFRSVGLPIGLPLSSMIPYTHFDVQFLEKFGVTFRREGETVTLKCTMLVTPDLKRVQPRAEWYRDDVLLKESKWTKMFFGEGQASLSFSHLHKDDEGLYTLRIVSRGGVSDHSAFLFVRDADPLVTGAPGAPMDLQCHDANRDYVIVTWKPPNTTTESPVMGYFVDRCEVGTNNWVQCNDAPVKICKYPVTGLFEGRSYIFRVRAVNSAGISRPSRVSDAVAALDPLDLRRLQAVHLEGEKEIAIYQDDLEGDAQVPGPPTGVHASEISRNYVVLSWEPPTPRGKDPLMYFIEKSVVGSGSWQRVNAQTAVRSPRYAVFDLMEGKSYVFRVLSANRHGLSEPSEITSPIQAQDVTVVPSAPGRVLASRNTKTSVVVQWDRPKHEEDLLGYYVDCCVAGTNLWEPCNHKPIGYNRFVVHGLTTGEQYIFRVKAVNAVGMSENSQESDVIKVQAALTVPSHPYGITLLNCDGHSMTLGWKVPKFSGGSPILGYYLDKREVHHKNWHEVNSSPSKPTILTVDGLTEGSLYEFKIAAVNLAGIGEPSDPSEHFKCEAWTMPEPGPAYDLTFCEVRDTSLVMLWKAPVYSGSSPVSGYFVDFREEDAGEWITVNQTTTANRYLKVSDLQQGKTYVFRVRAVNANGVGKPSDTSEPVLVEARPGTKEISAGVDEQGNIYLGFDCQEMTDASQFTWCKSYEEISDDERFKIETVGDHSKLYLKNPDKEDLGTYSVSVSDTDGVSSSFVLDPEELERLMALSNEIKNPTIPLKSELAYEIFDKGRVRFWLQAEHLSPDASYRFIINDREVSDSEIHRIKCDKATGIIEMVMDRFSIENEGTYTVQIHDGKAKSQSSLVLIGDAFKTVLEEAEFQRKEFLRKQGPHFAEYLHWDVTEECEVRLVCKVANTKKETVFKWLKDDVLYETETLPNLERGICELLIPKLSKKDHGEYKATLKDDRGQDVSILEIAGKVYDDMILAMSRVCGKSASPLKVLCTPEGIRLQCFMKYFTDEMKVNWCHKDAKISSSEHMRIGGSEEMAWLQICEPTEKDKGKYTFEIFDGKDNHQRSLDLSGQAFDEAFAEFQQFKAAAFAEKNRGRLIGGLPDVVTIMEGKTLNLTCTVFGNPDPEVIWFKNDQDIQLSEHFSVKVEQAKYVSMTIKGVTSEDSGKYSINIKNKYGGEKIDVTVSVYKHGEKIPDMAPPQQAKPKLIPASASAAGQ

SEQ ID NO: 54223 - protein, 890 aa, Homo sapiens
  Payload ID: 10713
  Gene Symbol: MYOM2
  Gene Name: myomesin 2
  ENSP ID: ENSP00000487697
MEGKSYVFRVLSANRHGLSEPSEITSPIQAQDVTVVPSAPGRVLASRNTKTSVVVQWDRPKHEEDLLGYYVDCCVAGTNLWEPCNHKPIGYNRFVVHGLTTGEQYIFRVKAVNAVGMSENSQESDVIKVQAALTVPSHPYGITLLNCDGHSMTLGWKVPKFSGGSPILGYYLDKREVHHKNWHEVNSSPSKPTILTVDGLTEGSLYEFKIAAVNLAGIGEPSDPSEHFKCEAWTMPEPGPAYDLTFCEVRDTSLVMLWKAPVYSGSSPVSGYFVDFREEDAGEWITVNQTTTANRYLKVSDLQQGKTYVFRVRAVNANGVGKPSDTSEPVLVEARPGTKEISAGVDEQGNIYLGFDCQEMTDASQFTWCKSYEEISDDERFKIETVGDHSKLYLKNPDKEDLGTYSVSVSDTDGVSSSFVLDPEELERLMALSNEIKNPTIPLKSELAYEIFDKGRVRFWLQAEHLSPDASYRFIINDREVSDSEIHRIKCDKATGIIEMVMDRFSIENEGTYTVQIHDGKAKSQSSLVLIGDAFKTVLEEAEFQRKEFLRKQGPHFAEYLHWDVTEECEVRLVCKVANTKKETVFKWLKDDVLYETETLPNLERGICELLIPKLSKKDHGEYKATLKDDRGQDVSILEIAGKVYDDMILAMSRVCGKSASPLKVLCTPEGIRLQCFMKYFTDEMKVNWCHKDAKISSSEHMRIGGSEEMAWLQICEPTEKDKGKYTFEIFDGKDNHQRSLDLSGQAFDEAFAEFQQFKAAAFAEKNRGRLIGGLPDVVTIMEGKTLNLTCTVFGNPDPEVIWFKNDQDIQLSEHFSVKVEQAKYVSMTIKGVTSEDSGKYSINIKNKYGGEKIDVTVSVYKHGEKIPDMAPPQQAKPKLIPASASAAGQ

SEQ ID NO: 54224 - protein, 330 aa, Homo sapiens
  Payload ID: 10714
  Gene Symbol: MYOM3
  Gene Name: myomesin 3
  Uniprot ID: Q5VTT5
  ENSP ID: ENSP00000342689
MDISKKNRVRQGSRGRGKTISKNSESRGQQRRHMVTNTKKETRFQWFFQRAEMPDGQYDPETGTGLLCIEELSKKDKGIYRAMVSDDRGEDDTILDLTGDALDAIFTELGRIGALSATPLKIQGTEEGIRIFSKVKYYNVEYMKTTWFHKDKRLESGDRIRTGTTLDEIWLHILDPKDSDKGKYTLEIAAGKEVRQLSTDLSGQAFEDAMAEHQRLKTLAIIEKNRAKVVRGLPDVATIMEDKTLCLTCIVSGDPTPEISWLKNDQPVTFLDRYRMEVRGTEVTITIEKVNSEDSGRYGVFVKNKYGSETGQVTISVFKHGDEPKELKSM

SEQ ID NO: 54225 - protein, 1437 aa, Homo sapiens
  Payload ID: 10714
  Gene Symbol: MYOM3
  Gene Name: myomesin 3
  Uniprot ID: Q5VTT5
  ENSP ID: ENSP00000363557
MTLPHSLGGAGDPRPPQAMEVHRLEHRQEEEQKEERQHSLRMGSSVRRRTFRSSEEEHEFSAADYALAAALALTASSELSWEAQLRRQTSAVELEERGQKRVGFGNDWERTEIAFLQTHRLLRQRRDWKTLRRRTEEKVQEAKELRELCYGRGPWFWIPLRSHAVWEHTTVLLTCTVQASPPPQVTWYKNDTRIDPRLFRAGKYRITNNYGLLSLEIRRCAIEDSATYTVRVKNAHGQASSFAKVLVRTYLGKDAGFDSEIFKRSTFGPSVEFTSVLKPVFAREKEPFSLSCLFSEDVLDAESIQWFRDGSLLRSSRRRKILYTDRQASLKVSCTYKEDEGLYMVRVPSPFGPREQSTYVLVRDAEAENPGAPGSPLNVRCLDVNRDCLILTWAPPSDTRGNPITAYTIERCQGESGEWIACHEAPGGTCRCPIQGLVEGQSYRFRVRAISRVGSSVPSKASELVVMGDHDAARRKTEIPFDLGNKITISTDAFEDTVTIPSPPTNVHASEIREAYVVLAWEEPSPRDRAPLTYSLEKSVIGSGTWEAISSESPVRSPRFAVLDLEKKKSYVFRVRAMNQYGLSDPSEPSEPIALRGPPATLPPPAQVQAFRDTQTSVSLTWDPVKDPELLGYYIYSRKVGTSEWQTVNNKPIQGTRFTVPGLRTGKEYEFCVRSVSEAGVGESSAATEPIRVKQALATPSAPYGFALLNCGKNEMVIGWKPPKRRGGGKILGYFLDQHDSEELDWHAVNQQPIPTRVCKVSDLHEGHFYEFRARAANWAGVGELSAPSSLFECKEWTMPQPGPPYDVRASEVRATSLVLQWEPPLYMGAGPVTGYHVSFQEEGSEQWKPVTPGPISGTHLRVSDLQPGKSYVFQVQAMNSAGLGQPSMPTDPVLLEDKPGAHEIEVGVDEEGFIYLAFEAPEAPDSSEFQWSKDYKGPLDPQRVKIEDKVNKSKVILKEPGLEDLGTYSVIVTDADEDISASHTLTEEELEKLKKLSHEIRNPVIKLISGWNIDILERGEVRLWLEVEKLSPAAELHLIFNNKEIFSSPNRKINFDREKGLVEVIIQNLSEEDKGSYTAQLQDGKAKNQITLTLVDDDFDKLLRKADAKRRDWKRKQGPYFERPLQWKVTEDCQVQLTCKVTNTKKETRFQWFFQRAEMPDGQYDPETGTGLLCIEELSKKDKGIYRAMVSDDRGEDDTILDLTGDALDAIFTELGRIGALSATPLKIQGTEEGIRIFSKVKYYNVEYMKTTWFHKDKRLESGDRIRTGTTLDEIWLHILDPKDSDKGKYTLEIAAGKEVRQLSTDLSGQAFEDAMAEHQRLKTLAIIEKNRAKVVRGLPDVATIMEDKTLCLTCIVSGDPTPEISWLKNDQPVTFLDRYRMEVRGTEVTITIEKVNSEDSGRYGVFVKNKYGSETGQVTISVFKHGDEPKELKSM

SEQ ID NO: 54226 - protein, 610 aa, Homo sapiens
  Payload ID: 10715
  Gene Symbol: MYNN
  Gene Name: myoneurin
  Uniprot ID: Q9NPC7
  ENSP ID: ENSP00000326240
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTGERPFICELCGNSYTDIKNLKKHKTKVHSGADKTLDSSAEDHTLSEQDSIQKSPLSETMDVKPSDMTLPLALPLGTEDHHMLLPVTDTQSPTSDTLLRSTVNGYSEPQLIFLQQLY

SEQ ID NO: 54227 - protein, 610 aa, Homo sapiens; identical to SEQ ID NO: 54226
  Payload ID: 10715
  Gene Symbol: MYNN
  Gene Name: myoneurin
  Uniprot ID: Q9NPC7
  ENSP ID: ENSP00000349150

SEQ ID NO: 54228 - protein, 581 aa, Homo sapiens
  Payload ID: 10715
  Gene Symbol: MYNN
  Gene Name: myoneurin
  Uniprot ID: Q9NPC7
  ENSP ID: ENSP00000440637
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVTVKRKRGKSQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTGADKTLDSSAEDHTLSEQDSIQKSPLSETMDVKPSDMTLPLALPLGTEDHHMLLPVTDTQSPTSDTLLRSTVNGYSEPQLIFLQQLY

SEQ ID NO: 54229 - protein, 238 aa, Homo sapiens
  Payload ID: 10715
  Gene Symbol: MYNN
  Gene Name: myoneurin
  ENSP ID: ENSP00000473335
  MOD_RES (1)..(1): Any amino acid
XQPNCALKEHSMSNIASVKSPYEAENSGEELDQRYSKAKPMCNTCGKVFSEASSLRRHMRIHKGVKPYVCHLCGKAFTQCNQLKTHVRTHTGEKPYKCELCDKGFAQKCQLVFHSRMHHGEEKPYKCDVCNLQFATSSNLKIHARKHSGEKPYVCDRCGQRFAQASTLTYHVRRHTGEKPYVCDTCGKAFAVSSSLITHSRKHTGEKPYICGICGKSFISSGELNKHFRSHTVVWSMN

SEQ ID NO: 54230 - protein, 91 aa, Homo sapiens
  Payload ID: 10715
  Gene Symbol: MYNN
  Gene Name: myoneurin
  Uniprot ID: Q9NPC7
  ENSP ID: ENSP00000473654
MQYSHHCEHLLERLNKQREAGFLCDCTIVIGEFQFKAHRNVLASFSEYFGAIYRSTSENNVFLDQSQVKADGFQKLLEFIYTGTLNLDRDI

SEQ ID NO: 54231 - protein, 1045 aa, Homo sapiens
  Payload ID: 10716
  Gene Symbol: MYPN
  Gene Name: myopalladin
  Uniprot ID: Q86TC9
  ENSP ID: ENSP00000346369
MLTVQVKTSSAIELPDSLAFLWIIPMWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKKPRSMAEPEEICTLVIAEVFAEDSGCFTCTASNKYGTVSSIAQLHVRGNEDLSNNGSLHSANSTTNLAAIEPQPSPPHSEPPSVEQPPKPKLEGVLVNHNEPRSSSRIGLRVHFNLPEDDKGSEASSEAGVVTTRQTRPDSFQERFNGQATKTPEPSSPVKEPPPVLAKPKLDSTQLQQLHNQVLLEQHQLQNPPPSSPKEFPFSMTVLNSNAPPAVTTSSKQVKAPSSQTFSLARPKYFFPSTNTTAATVAPSSSPVFTLSSTPQTIQRTVSKESLLVSHPSVQTKSPGGLSIQNEPLPPGPTEPTPPPFTFSIPSGNQFQPRCVSPIPVSPTSRIQNPVAFLSSVLPSLPAIPPTNAMGLPRSAPSMPSQGLAKKNTKSPQPVNDDNIRETKNAVIRDLGKKITFSDVRPNQQEYKISSFEQRLMNEIEFRLERTPVDESDDEIQHDEIPTGKCIAPIFDKRLKHFRVTEGSPVTFTCKIVGIPVPKVYWFKDGKQISKRNEHCKMRREGDGTCSLHIESTTSDDDGNYTIMAANPQGRISCSGHLMVQSLPIRSRLTSAGQSHRGRSRVQERDKEPLQERFFRPHFLQAPGDMVAHEGRLCRLDCKVSGLPPPELTWLLNGQPVLPDASHKMLVRETGVHSLLIDPLTQRDAGTYKCIATNKTGQNSFSLELSVVAKEVKKAPVILEKLQNCGVPEGHPVRLECRVIGMPPPVFYWKKDNETIPCTRERISMHQDTTGYACLLIQPAKKSDAGWYTLSAKNEAGIVSCTARLDIYAQWHHQIPPPMSVRPSGSRYGSLTSKGLDIFSAFSSMESTMVYSCSSRSVVESDEL

SEQ ID NO: 54232 - protein, 1320 aa, Homo sapiens
  Payload ID: 10716
  Gene Symbol: MYPN
  Gene Name: myopalladin
  Uniprot ID: Q86TC9
  ENSP ID: ENSP00000351790
MQDDSIEASTSISQLLRESYLAETRHRGNNERSRAEPSSNPCHFGSPSGAAEGGGGQDDLPDLSAFLSQEELDESVNLARLAINYDPLEKADETQARKRLSPDQMKHSPNLSFEPNFCQDNPRSPTSSKESPQEAKRPQYCSETQSKKVFLNKAADFIEELSSLFKSHSSKRIRPRACKNHKSKLESQNKVMQENSSSFSDLSERRERSSVPIPIPADTRDNEVNHALEQQEAKRREAEQAASEAAGGDTTPGSSPSSLYYEEPLGQPPRFTQKLRSREVPEGTRVQLDCIVVGIPPPQVRWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKKPRSMAEPEEICTLVIAEVFAEDSGCFTCTASNKYGTVSSIAQLHVRGNEDLSNNGSLHSANSTTNLAAIEPQPSPPHSEPPSVEQPPKPKLEGVLVNHNEPRSSSRIGLRVHFNLPEDDKGSEASSEAGVVTTRQTRPDSFQERFNGQATKTPEPSSPVKEPPPVLAKPKLDSTQLQQLHNQVLLEQHQLQNPPPSSPKEFPFSMTVLNSNAPPAVTTSSKQVKAPSSQTFSLARPKYFFPSTNTTAATVAPSSSPVFTLSSTPQTIQRTVSKESLLVSHPSVQTKSPGGLSIQNEPLPPGPTEPTPPPFTFSIPSGNQFQPRCVSPIPVSPTSRIQNPVAFLSSVLPSLPAIPPTNAMGLPRSAPSMPSQGLAKKNTKSPQPVNDDNIRETKNAVIRDLGKKITFSDVRPNQQEYKISSFEQRLMNEIEFRLERTPVDESDDEIQHDEIPTGKCIAPIFDKRLKHFRVTEGSPVTFTCKIVGIPVPKVYWFKDGKQISKRNEHCKMRREGDGTCSLHIESTTSDDDGNYTIMAANPQGRISCSGHLMVQSLPIRSRLTSAGQSHRGRSRVQERDKEPLQERFFRPHFLQAPGDMVAHEGRLCRLDCKVSGLPPPELTWLLNGQPVLPDASHKMLVRETGVHSLLIDPLTQRDAGTYKCIATNKTGQNSFSLELSVVAKEVKKAPVILEKLQNCGVPEGHPVRLECRVIGMPPPVFYWKKDNETIPCTRERISMHQDTTGYACLLIQPAKKSDAGWYTLSAKNEAGIVSCTARLDIYAQWHHQIPPPMSVRPSGSRYGSLTSKGLDIFSAFSSMESTMVYSCSSRSVVESDEL

SEQ ID NO: 54233 - protein, 507 aa, Homo sapiens
  Payload ID: 10716
  Gene Symbol: MYPN
  Gene Name: myopalladin
  Uniprot ID: Q86TC9
  ENSP ID: ENSP00000362779
MQDDSIEASTSISQLLRESYLAETRHRGNNERSRAEPSSNPCHFGSPSGAAEGGGGQDDLPDLSAFLSQEELDESVNLARLAINYDPLEKADETQARKRLSPDQMKHSPNLSFEPNFCQDNPRSPTSSKESPQEAKRPQYCSETQSKKVFLNKAADFIEELSSLFKSHSSKRIRPRACKNHKSKLESQNKVMQENSSSFSDLSERRERSSVPIPIPADTRDNEVNHALEQQEAKRREAEQAASEAAGGDTTPGSSPSSLYYEEPLGQPPRFTQKLRSREVPEGTRVQLDCIVVGIPPPQVRWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKKPRSMAEPGKDDFNFNLLVYE

SEQ ID NO: 54234 - protein, 1320 aa, Homo sapiens; identical to SEQ ID NO: 54232
  Payload ID: 10716
  Gene Symbol: MYPN
  Gene Name: myopalladin
  Uniprot ID: Q86TC9
  ENSP ID: ENSP00000441668

SEQ ID NO: 54235 - protein, 1026 aa, Homo sapiens
  Payload ID: 10716
  Gene Symbol: MYPN
  Gene Name: myopalladin
  ENSP ID: ENSP00000480757
MFPLSFWWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKKPRSMAEPEEICTLVIAEVFAEDSGCFTCTASNKYGTVSSIAQLHVRGNEDLSNNGSLHSANSTTNLAAIEPQPSPPHSEPPSVEQPPKPKLEGVLVNHNEPRSSSRIGLRVHFNLPEDDKGSEASSEAGVVTTRQTRPDSFQERFNGQATKTPEPSSPVKEPPPVLAKPKLDSTQLQQLHNQVLLEQHQLQNPPPSSPKEFPFSMTVLNSNAPPAVTTSSKQVKAPSSQTFSLARPKYFFPSTNTTAATVAPSSSPVFTLSSTPQTIQRTVSKESLLVSHPSVQTKSPGGLSIQNEPLPPGPTEPTPPPFTFSIPSGNQFQPRCVSPIPVSPTSRIQNPVAFLSSVLPSLPAIPPTNAMGLPRSAPSMPSQGLAKKNTKSPQPVNDDNIRETKNAVIRDLGKKITFSDVRPNQQEYKISSFEQRLMNEIEFRLERTPVDESDDEIQHDEIPTGKCIAPIFDKRLKHFRVTEGSPVTFTCKIVGIPVPKVYWFKDGKQISKRNEHCKMRREGDGTCSLHIESTTSDDDGNYTIMAANPQGRISCSGHLMVQSLPIRSRLTSAGQSHRGRSRVQERDKEPLQERFFRPHFLQAPGDMVAHEGRLCRLDCKVSGLPPPELTWLLNGQPVLPDASHKMLVRETGVHSLLIDPLTQRDAGTYKCIATNKTGQNSFSLELSVVAKEVKKAPVILEKLQNCGVPEGHPVRLECRVIGMPPPVFYWKKDNETIPCTRERISMHQDTTGYACLLIQPAKKSDAGWYTLSAKNEAGIVSCTARLDIYAQWHHQIPPPMSVRPSGSRYGSLTSKGLDIFSAFSSMESTMVYSCSSRSVVESDEL

SEQ ID NO: 54236 - protein, 1 aa, Homo sapiens
  Payload ID: 10717
  Gene Symbol: MRLN
  Gene Name: myoregulin
  ENSP ID: ENSP00000487738
M

SEQ ID NO: 54237 - protein, 46 aa, Homo sapiens
  Payload ID: 10717
  Gene Symbol: MRLN
  Gene Name: myoregulin
  Uniprot ID: P0DMT0
  ENSP ID: ENSP00000488299
MTGKNWILISTTTPKSLEDEIVGRLLKILFVIFVDLISIIYVVITS

SEQ ID NO: 54238 - protein, 46 aa, Homo sapiens; identical to SEQ ID NO: 54237
  Payload ID: 10717
  Gene Symbol: MRLN
  Gene Name: myoregulin
  Uniprot ID: P0DMT0
  ENSP ID: ENSP00000488429

SEQ ID NO: 54239 - protein, 46 aa, Homo sapiens; identical to SEQ ID NO: 54237
  Payload ID: 10717
  Gene Symbol: MRLN
  Gene Name: myoregulin
  Uniprot ID: P0DMT0
  ENSP ID: ENSP00000488584

SEQ ID NO: 54240 - protein, 1 aa, Homo sapiens
  Payload ID: 10717
  Gene Symbol: MRLN
  Gene Name: myoregulin
  ENSP ID: ENSP00000488673
M

SEQ ID NO: 54241 - protein, 46 aa, Homo sapiens; identical to SEQ ID NO: 54237
  Payload ID: 10717
  Gene Symbol: MRLN
  Gene Name: myoregulin
  Uniprot ID: P0DMT0
  ENSP ID: ENSP00000488748

SEQ ID NO: 54242 - protein, 1274 aa, Homo sapiens [sequence omitted]

SEQ ID NO: 54243 - protein, 1274 aa, Homo sapiens
  Payload ID: 10718
  Gene Symbol: MYBPC3
  Gene Name: myosin binding protein C, cardiac
  ENSP ID: ENSP00000382193
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFDCSNFNLTVHEAMGTGDLDLLSAFRRTSLAGGGRRISDSHEDTGILDFSSLLKKSSSFRTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALAELIVQEKKLEVYQSIADLMVGAKDQAVFKCEVSDENVRGVWLKNGKELVPDSRIKVSHIGRVHKLTIDDVTPADEADYSFVPEGFACNLSAKLHFMEVKIDFVPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILQRPRLQLPRHLRQTIQKKVGEPVNLLIPFQGKPRPQVTWTKEGQPLAGEEVSIRNSPTDTILFIRAARRVHSGTYQVTVRIENMEDKATLVLQVVDKPSPPQDLRVTDAWGLNVALEWKPPQDVGNTELWGYTVQKADKKTMEWFTVLEHYRRTHCVVPELIIGNGYYFRVFSQNMVGFSDRAATTKEPVFIPRPGITYEPPNYKALDFSEAPSFTQPLVNRSVIAGYTAMLCCAVRGSPKPKISWFKNGLDLGEDARFRMFSKQGVLTLEIRKPCPFDGGIYVCRATNLQGEARCECRLEVRVPQ

SEQ ID NO: 54244 - protein, 1274 aa, Homo sapiens
  Payload ID: 10718
  Gene Symbol: MYBPC3
  Gene Name: myosin binding protein C, cardiac
  Uniprot ID: Q14896
  ENSP ID: ENSP00000442795
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFDCSNFNLTVHEAMGTGDLDLLSAFRRTSLAGGGRRISDSHEDTGILDFSSLLKKRDSFRTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALAELIVQEKKLEVYQSIADLMVGAKDQAVFKCEVSDENVRGVWLKNGKELVPDSRIKVSHIGRVHKLTIDDVTPADEADYSFVPEGFACNLSAKLHFMEVKIDFVPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILQRPRLQLPRHLRQTIQKKVGEPVNLLIPFQGKPRPQVTWTKEGQPLAGEEVSIRNSPTDTILFIRAARRVHSGTYQVTVRIENMEDKATLVLQVVDKPSPPQDLRVTDAWGLNVALEWKPPQDVGNTELWGYTVQKADKKTMEWFTVLEHYRRTHCVVPELIIGNGYYFRVFSQNMVGFSDRAATTKEPVFIPRPGITYEPPNYKALDFSEAPSFTQPLVNRSVIAGYTAMLCCAVRGSPKPKISWFKNGLDLGEDARFRMFSKQGVLTLEIRKPCPFDGGIYVCRATNLQGEARCECRLEVRVPQ

SEQ ID NO: 54245 - protein, 808 aa, Homo sapiens
  Payload ID: 10718
  Gene Symbol: MYBPC3
  Gene Name: myosin binding protein C, cardiac
  ENSP ID: ENSP00000444259
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFDCSNFNLTVHEAMGTGDLDLLSAFRRTSLAGGGRRISDSHEDTGILDFSSLLKKRDSFRTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALAELIVQEKKLEVYQSIADLMVGAKDQAVFKCEVSDENVRGVWLKNGKELVPDSRIKVSHIGRVHKLTIDDVTPADEADYSFVPEGFACNLSAKLHFMEVKIDFVPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGAES

SEQ ID NO: 54246 - protein, 1141 aa, Homo sapiens
  Payload ID: 10719
  Gene Symbol: MYBPC2
  Gene Name: myosin binding protein C, fast type
  Uniprot ID: Q14324
  ENSP ID: ENSP00000350332
MPEAKPAAKKAPKGKDAPKGAPKEAPPKEAPAEAPKEAPPEDQSPTAEEPTGVFLKKPDSVSVETGKDAVVVAKVNGKELPDKPTIKWFKGKWLELGSKSGARFSFKESHNSASNVYTVELHIGKVVLGDRGYYRLEVKAKDTCDSCGFNIDVEAPRQDASGQSLESFKRTSEKKSDTAGELDFSGLLKKREVVEEEKKKKKKDDDDLGIPPEIWELLKGAKKSEYEKIAFQYGITDLRGMLKRLKKAKVEVKKSAAFTKKLDPAYQVDRGNKIKLMVEISDPDLTLKWFKNGQEIKPSSKYVFENVGKKRILTINKCTLADDAAYEVAVKDEKCFTELFVKEPPVLIVTPLEDQQVFVGDRVEMAVEVSEEGAQVMWMKDGVELTREDSFKARYRFKKDGKRHILIFSDVVQEDRGRYQVITNGGQCEAELIVEEKQLEVLQDIADLTVKASEQAVFKCEVSDEKVTGKWYKNGVEVRPSKRITISHVGRFHKLVIDDVRPEDEGDYTFVPDGYALSLSAKLNFLEIKVEYVPKQEPPKIHLDCSGKTSENAIVVVAGNKLRLDVSITGEPPPVATWLKGDEVFTTTEGRTRIEKRVDCSSFVIESAQREDEGRYTIKVTNPVGEDVASIFLQVVDVPDPPEAVRITSVGEDWAILVWEPPMYDGGKPVTGYLVERKKKGSQRWMKLNFEVFTETTYESTKMIEGILYEMRVFAVNAIGVSQPSMNTKPFMPIAPTSEPLHLIVEDVTDTTTTLKWRPPNRIGAGGIDGYLVEYCLEGSEEWVPANTEPVERCGFTVKNLPTGARILFRVVGVNIAGRSEPATLAQPVTIREIAEPPKIRLPRHLRQTYIRKVGEQLNLVVPFQGKPRPQVVWTKGGAPLDTSRVHVRTSDFDTVFFVRQAARSDSGEYELSVQIENMKDTATIRIRVVEKAGPPINVMVKEVWGTNALVEWQAPKDDGNSEIMGYFVQKADKKTMEWFNVYERNRHTSCTVSDLIVGNEYYFRVYTENICGLSDSPGVSKNTARILKTGITFKPFEYKEHDFRMAPKFLTPLIDRVVVAGYSAALNCAVRGHPKPKVVWMKNKMEIREDPKFLITNYQGVLTLNIRRPSPFDAGTYTCRAVNELGEALAECKLEVRVPQ

SEQ ID NO: 54247 - protein, 1148 aa, Homo sapiens
  Payload ID: 10720
  Gene Symbol: MYBPC1
  Gene Name: myosin binding protein C, slow type
  Uniprot ID: Q00872
  ENSP ID: ENSP00000354845
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 54248 - protein, 1171 aa, Homo sapiens
  Payload ID: 10720
  Gene Symbol: MYBPC1
  Gene Name: myosin binding protein C, slow type
  Uniprot ID: Q00872
  ENSP ID: ENSP00000354849
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 54249 - protein, 1139 aa, Homo sapiens
  Payload ID: 10720
  Gene Symbol: MYBPC1
  Gene Name: myosin binding protein C, slow type
  Uniprot ID: Q00872
  ENSP ID: ENSP00000376665
MPEPTKKEDEEEVSPPSALPPDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKGGLSFCRLLLQGVPPNIIDSYLRDLHSSNPEEY

SEQ ID NO: 54250 - protein, 782 aa, Homo sapiens
  Payload ID: 10720
  Gene Symbol: MYBPC1
  Gene Name: myosin binding protein C, slow type
  ENSP ID: ENSP00000388989
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPRPHWCSRFRWLCARVLL

SEQ ID NO: 54251 - protein, 1173 aa, Homo sapiens
  Payload ID: 10720
  Gene Symbol: MYBPC1
  Gene Name: myosin binding protein C, slow type
  Uniprot ID: Q00872
  ENSP ID: ENSP00000400908
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGSTSAKQSDENGEAAYDLPAEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQVGSPSADSSCKAYLQT

SEQ ID NO: 54252 - protein, 1146 aa, Homo sapiens
  Payload ID: 10720
  Gene Symbol: MYBPC1
  Gene Name: myosin binding protein C, slow type
  Uniprot ID: Q00872
  ENSP ID: ENSP00000440034
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 54253 - protein, 1134 aa, Homo sapiens
  Payload ID: 10720
  Gene Symbol: MYBPC1
  Gene Name: myosin binding protein C, slow type
  Uniprot ID: Q00872
  ENSP ID: ENSP00000442847
MPEPTKKEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 54254 - protein, 1127 aa, Homo sapiens
  Payload ID: 10720
  Gene Symbol: MYBPC1
  Gene Name: myosin binding protein C, slow type
  Uniprot ID: Q00872
  ENSP ID: ENSP00000446128
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 54255 - protein, 1024 aa, Homo sapiens
  Payload ID: 10720
  Gene Symbol: MYBPC1
  Gene Name: myosin binding protein C, slow type
  ENSP ID: ENSP00000447116
MDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 54256 - protein, 1132 aa, Homo sapiens
  Payload ID: 10720
  Gene Symbol: MYBPC1
  Gene Name: myosin binding protein C, slow type
  ENSP ID: ENSP00000447362
MPEPTKKEENEVPAPAPPPEDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 54257 - protein, 104 aa, Homo sapiens
  Payload ID: 10720
  Gene Symbol: MYBPC1
  Gene Name: myosin binding protein C, slow type
  ENSP ID: ENSP00000447404
MDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQE

SEQ ID NO: 54258 - protein, 1154 aa, Homo sapiens
  Payload ID: 10720
  Gene Symbol: MYBPC1
  Gene Name: myosin binding protein C, slow type
  ENSP ID: ENSP00000447660
MPEPTKKEENEVPAPAPPPEEPSKEKEAGTTPAKDEEEVSPPSALPPDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGSTSAKQSDENGEAAYDLPAEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 54259 - protein, 1123 aa, Homo sapiens
  Payload ID: 10720
  Gene Symbol: MYBPC1
  Gene Name: myosin binding protein C, slow type
  Uniprot ID: Q00872
  ENSP ID: ENSP00000447900
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 54260 - protein, 1120 aa, Homo sapiens
  Payload ID: 10720
  Gene Symbol: MYBPC1
  Gene Name: myosin binding protein C, slow type
  Uniprot ID: Q00872
  ENSP ID: ENSP00000448175
MPEPTKKEDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 54261 - protein, 1141 aa, Homo sapiens
  Payload ID: 10720
  Gene Symbol: MYBPC1
  Gene Name: myosin binding protein C, slow type
  Uniprot ID: Q00872
  ENSP ID: ENSP00000449702
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGSTSAKQSDENGEAAYDLPAEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 54262 - protein, 477 aa, Homo sapiens
  Payload ID: 10721
  Gene Symbol: MYBPH
  Gene Name: myosin binding protein H
  Uniprot ID: Q13203
  ENSP ID: ENSP00000255416
MMEKNTSEGPACSPEETASESAKVPTAEPPGEVAVSESTREEQVPKPQAPAPQAPTASTATKPAPPSEDVPSAPLLLTLDDVSSSSVTVSWEPPERLGRLGLQGYVLELCREGASEWVPVSARPMMVTQQTVRNLALGDKFLLRVSAVSSAGAGPPAMLDQPIHIRENIEAPKIRVPRHLRQTYIRQVGETVNLQIPFQGKPKPQATWTHNGHALDSQRVSMRTGDQDSILFIRSAQRSDSGRYELTVRVEDLEAKAVIDILVIEKPGPPSSIRLLDVWGCNAALQWTPPQDTGNTELLGYMVQKADKKTGQWFTVLERYHPTTCTISDLIIGNSYSFRVFSENLCGLSTSATVTKELAHIQKADIAAKPKGFIERDFSEAPSFTQPLADHTSTPGYSTQLFCSVRASPKPKIIWMKNKMEIQGNPKYRALSEQGVCTLEIRKPSPFDSGVYTCKAINVLGEASVDCRLEVKASAAH

SEQ ID NO: 54263 - protein, 476 aa, Homo sapiens [sequence omitted]

SEQ ID NO: 54264 - protein, 354 aa, Homo sapiens
  Payload ID: 10722
  Gene Symbol: MYBPHL
  Gene Name: myosin binding protein H-like
  Uniprot ID: A2RUH7
  ENSP ID: ENSP00000349678
MEAATAPEVAAGSKLKVKEASPADAEPPQASPGQGAGSPTPQLLPPIEEHPKIWLPRALRQTYIRKVGDTVNLLIPFQGKPKPQAIWTHDGCALDTRRVSVRNGEQDSILFIREAQRADSGRYQLRVQLGGLEATATIDILVIERPGPPQSIKLVDVWGFSATLEWTPPQDTGNTALLGYTVQKADTKSGLWFTVLEHYHRTSCIVSDLIIGNSYAFRVFAENQCGLSETAPITTDLAHIQKAATVYKTKGFAQRDFSEAPKFTQPLADCTTVTGYNTQLFCCVRASPRPKIIWLKNKMDIQGNPKYRALTHLGICSLEIRKPGPFDGGIYTCKAVNPLGEASVDCRVDVKVPN

SEQ ID NO: 54265 - protein, 1043 aa, Homo sapiens
  Payload ID: 10723
  Gene Symbol: MYO1A
  Gene Name: myosin IA
  Uniprot ID: Q9UBC5
  ENSP ID: ENSP00000300119
MPLLEGSVGVEDLVLLEPLVEESLLKNLQLRYENKEIYTYIGNVVISVNPYQQLPIYGPEFIAKYQDYTFYELKPHIYALANVAYQSLRDRDRDQCILITGESGSGKTEASKLVMSYVAAVCGKGEQVNSVKEQLLQSNPVLEAFGNAKTIRNNNSSRFGKYMDIEFDFKGSPLGGVITNYLLEKSRLVKQLKGERNFHIFYQLLAGADEQLLKALKLERDTTGYAYLNHEVSRVDGMDDASSFRAVQSAMAVIGFSEEEIRQVLEVTSMVLKLGNVLVADEFQASGIPASGIRDGRGVREIGEMVGLNSEEVERALCSRTMETAKEKVVTALNVMQAQYARDALAKNIYSRLFDWIVNRINESIKVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMQKKCYGKIKASVLLIQAFVRGWKARKNYRKYFRSEAALTLADFIYKSMVQKFLLGLKNNLPSTNVLDKTWPAAPYKCLSTANQELQQLFYQWKCKRFRDQLSPKQVEILREKLCASELFKGKKASYPQSVPIPFCGDYIGLQGNPKLQKLKGGEEGPVLMAEAVKKVNRGNGKTSSRILLLTKGHVILTDTKKSQAKIVIGLDNVAGVSVTSLKDGLFSLHLSEMSSVGSKGDFLLVSEHVIELLTKMYRAVLDATQRQLTVTVTEKFSVRFKENSVAVKVVQGPAGGDNSKLRYKKKGSHCLEVTVQ

SEQ ID NO: 54266 - protein, 1043 aa, Homo sapiens; identical to SEQ ID NO: 54265
  Payload ID: 10723
  Gene Symbol: MYO1A
  Gene Name: myosin IA
  Uniprot ID: Q9UBC5
  ENSP ID: ENSP00000393392

SEQ ID NO: 54267 - protein, 96 aa, Homo sapiens
  Payload ID: 10723
  Gene Symbol: MYO1A
  Gene Name: myosin IA
  ENSP ID: ENSP00000400991
MPLLEGSVGVEDLVLLEPLVEESLLKNLQLRYENKEIYTYIGNVVISVNPYQQLPIYGPEFIAKYQDYTFYELKPHIYALANVAYQSLRDRDRDQC

SEQ ID NO: 54268 - protein, 688 aa, Homo sapiens
  Payload ID: 10723
  Gene Symbol: MYO1A
  Gene Name: myosin IA
  ENSP ID: ENSP00000451033
MDIEFDFKGSPLGGVITNYLLEKSRLVKQLKGERNFHIFYQLLAGADEQLLKALKLERDTTGYAYLNHEVSRVDGMDDASSFRAVQSAMAVIGFSEEEIRQVLEVTSMVLKLGNVLVADEFQASGIPASGIRDGRGVREIGEMVGLNSEEVERALCSRTMETAKEKVVTALNVMQAQYARDALAKNIYSRLFDWIVNRINESIKVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMQKKCYGKIKASVLLIQAFVRGWKARKNYRKYFRSEAALTLADFIYKSMVQKFLLGLKNNLPSTNVLDKTWPAAPYKCLSTANQELQQLFYQWKAKVPGSAVPEAGRDPEGKALCQ

SEQ ID NO: 54269 - protein, 73 aa, Homo sapiens
  Payload ID: 10723
  Gene Symbol: MYO1A
  Gene Name: myosin IA
  ENSP ID: ENSP00000452229
MVGLNSEEVERALCSRTMETAKEKVVTALNVMQAQYARDALAKNIYSRLFDWIVNRINESIKVGIGEKKKVMG

SEQ ID NO: 54270 - protein, 1136 aa, Homo sapiens
  Payload ID: 10724
  Gene Symbol: MYO1B
  Gene Name: myosin IB
  Uniprot ID: O43795
  ENSP ID: ENSP00000306382
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQARRELRRLKEEARNKHAIAVIWAYWLGSKARRELKRLKEEARRKHAVAVIWAYWLGLKVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 54271 - protein, 1078 aa, Homo sapiens
  Payload ID: 10724
  Gene Symbol: MYO1B
  Gene Name: myosin IB
  Uniprot ID: O43795
  ENSP ID: ENSP00000341903
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 54272 - protein, 1107 aa, Homo sapiens
  Payload ID: 10724
  Gene Symbol: MYO1B
  Gene Name: myosin IB
  ENSP ID: ENSP00000376130
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQARRELKRLKEEARRKHAVAVIWAYWLGLKVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 54273 - protein, 1136 aa, Homo sapiens; identical to SEQ ID NO: 54270
  Payload ID: 10724
  Gene Symbol: MYO1B
  Gene Name: myosin IB
  Uniprot ID: O43795
  ENSP ID: ENSP00000376132

SEQ ID NO: 54274 - protein, 83 aa, Homo sapiens
  Payload ID: 10724
  Gene Symbol: MYO1B
  Gene Name: myosin IB
  ENSP ID: ENSP00000387610
MAKMEVKTSLLDNMIGVGDMVLLEPLNEETFINNLKKRFDHSEIYTYIGSVVISVNPYRSLPIYSPEKVEEYRNRNFYELSPH

SEQ ID NO: 54275 - protein, 303 aa, Homo sapiens
  Payload ID: 10724
  Gene Symbol: MYO1B
  Gene Name: myosin IB
  ENSP ID: ENSP00000388140
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDK

SEQ ID NO: 54276 - protein, 149 aa, Homo sapiens
  Payload ID: 10724
  Gene Symbol: MYO1B
  Gene Name: myosin IB
  ENSP ID: ENSP00000399459
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVL

SEQ ID NO: 54277 - protein, 163 aa, Homo sapiens
  Payload ID: 10724
  Gene Symbol: MYO1B
  Gene Name: myosin IB
  ENSP ID: ENSP00000401324
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNS

SEQ ID NO: 54278 - protein, 192 aa, Homo sapiens
  Payload ID: 10724
  Gene Symbol: MYO1B
  Gene Name: myosin IB
  ENSP ID: ENSP00000408454
  MOD_RES (1)..(1): Any amino acid
XCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEYVHVLFENPFSLSAFLF

SEQ ID NO: 54279 - protein, 189 aa, Homo sapiens
  Payload ID: 10724
  Gene Symbol: MYO1B
  Gene Name: myosin IB
  ENSP ID: ENSP00000489544
  MOD_RES (1)..(1): Any amino acid
XAKNLYSRLFSWLVNRINESIKAQTKVRKKVMGVLDIYGFEIFENADNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDL

SEQ ID NO: 54280 - protein, 1063 aa, Homo sapiens
  Payload ID: 10725
  Gene Symbol: MYO1C
  Gene Name: myosin IC
  Uniprot ID: O00159
  ENSP ID: ENSP00000352834
MALQVELVPTGEIIRVVHPHRPCKLALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFVLRHAPRCPENAFFLDHVRTSFLLNLRRQLPQNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 54281 - protein, 1028 aa, Homo sapiens
  Payload ID: 10725
  Gene Symbol: MYO1C
  Gene Name: myosin IC
  Uniprot ID: O00159
  ENSP ID: ENSP00000354283
MESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFVLRHAPRCPENAFFLDHVRTSFLLNLRRQLPQNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 54282 - protein, 1044 aa, Homo sapiens
  Payload ID: 10725
  Gene Symbol: MYO1C
  Gene Name: myosin IC
  Uniprot ID: O00159
  ENSP ID: ENSP00000412197
MRYRASALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFVLRHAPRCPENAFFLDHVRTSFLLNLRRQLPQNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 54283 - protein, 1039 aa, Homo sapiens
  Payload ID: 10725
  Gene Symbol: MYO1C
  Gene Name: myosin IC
  ENSP ID: ENSP00000437685
MALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFVLRHAPRCPENAFFLDHVRTSFLLNLRRQLPQNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 54284 - protein, 134 aa, Homo sapiens
  Payload ID: 10725
  Gene Symbol: MYO1C
  Gene Name: myosin IC
  ENSP ID: ENSP00000458610
MESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGA

SEQ ID NO: 54285 - protein, 1028 aa, Homo sapiens; identical to SEQ ID NO: 54281
  Payload ID: 10725
  Gene Symbol: MYO1C
  Gene Name: myosin IC
  Uniprot ID: O00159
  ENSP ID: ENSP00000459174

SEQ ID NO: 54286 - protein, 267 aa, Homo sapiens
  Payload ID: 10725
  Gene Symbol: MYO1C
  Gene Name: myosin IC
  ENSP ID: ENSP00000459271
MESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVE

SEQ ID NO: 54287 - protein, 65 aa, Homo sapiens
  Payload ID: 10725
  Gene Symbol: MYO1C
  Gene Name: myosin IC
  ENSP ID: ENSP00000459558
  MOD_RES (1)..(1): Any amino acid
XTEDALEVRRQSLATLPFMPLVERTRHQAPSWLPALWPIAFLSQPQPQRSKLPGGAFTGGRNSSG

SEQ ID NO: 54288 - protein, 137 aa, Homo sapiens
  Payload ID: 10725
  Gene Symbol: MYO1C
  Gene Name: myosin IC
  ENSP ID: ENSP00000460415
MESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRD

SEQ ID NO: 54289 - protein, 170 aa, Homo sapiens
  Payload ID: 10725
  Gene Symbol: MYO1C
  Gene Name: myosin IC
  ENSP ID: ENSP00000460831
MESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQ

SEQ ID NO: 54290 - protein, 164 aa, Homo sapiens
  Payload ID: 10725
  Gene Symbol: MYO1C
  Gene Name: myosin IC
  ENSP ID: ENSP00000461175
MESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFG

SEQ ID NO: 54291 - protein, 168 aa, Homo sapiens
  Payload ID: 10725
  Gene Symbol: MYO1C
  Gene Name: myosin IC
  ENSP ID: ENSP00000461682
MPCALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTL

SEQ ID NO: 54292 - protein, 1006 aa, Homo sapiens
  Payload ID: 10726
  Gene Symbol: MYO1D
  Gene Name: myosin ID
  Uniprot ID: O94832
  ENSP ID: ENSP00000324527
MAEQESLEFGKADFVLMDTVSMPEFMANLRLRFEKGRIYTFIGEVVVSVNPYKLLNIYGRDTIEQYKGRELYERPPHLFAIADAAYKAMKRRSKDTCIVISGESGAGKTEASKYIMQYIAAITNPSQRAEVERVKNMLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKEPYYVRCIKPNDKKSPQIFDDERCRHQVEYLGLLENVRVRRAGFAFRQTYEKFLHRYKMISEFTWPNHDLPSDKEAVKKLIERCGFQDDVAYGKTKIFIRTPRTLFTLEELRAQMLIRIVLFLQKVWRGTLARMRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKVNRFSKVEDRAIFVTDRHLYKMDPTKQYKVMKTIPLYNLTGLSVSNGKDQLVVFHTKDNKDLIVCLFSKQPTHESRIGELVGVLVNHFKSEKRHLQVNVTNPVQCSLHGKKCTVSVETRLNQPQPDFTKNRSGFILSVPGN

SEQ ID NO: 54293 - protein, 436 aa, Homo sapiens
  Payload ID: 10726
  Gene Symbol: MYO1D
  Gene Name: myosin ID
  ENSP ID: ENSP00000462055
MAEQESLEFGKADFVLMDTVSMPEFMANLRLRFEKGRIYTFIGEVVVSVNPYKLLNIYGRDTIEQYKGRELYERPPHLFAIADAAYKAMKRRSKDTCIVISGESGAGKTEASKYIMQYIAAITNPSQRAEVERVKNMLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHVGLL

SEQ ID NO: 54294 - protein, 961 aa, Homo sapiens
  Payload ID: 10726
  Gene Symbol: MYO1D
  Gene Name: myosin ID
  ENSP ID: ENSP00000464305
MAEQESLEFGKADFVLMDTVSMPEFMANLRLRFEKGRIYTFIGEVVVSVNPYKLLNIYGRDTIEQYKGRELYERPPHLFAIADAAYKAMKRRSKDTCIVISGESGAGKTEASKYIMQYIAAITNPSQRAEVERVKNMLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKEPYYVRCIKPNDKKSPQIFDDERCRHQVEYLGLLENVRVRRAGFAFRQTYEKFLHRYKMISEFTWPNHDLPSDKEAVKKLIERCGFQDDVAYGKTKIFIRTPRTLFTLEELRAQMLIRIVLFLQKVWRGTLARMRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKVNRFSKVEDRAIFVTDRHLYKMDPTKQYKVMKTIPLYNLTGLSVSNGKDQLVVFHTKDNKDLIVCLFSKQPTHESRIGELVGVLVNHFKRNHLLIL

SEQ ID NO: 54295 - protein, 44 aa, Homo sapiens
  Payload ID: 10726
  Gene Symbol: MYO1D
  Gene Name: myosin ID
  ENSP ID: ENSP00000464346
KHAHFSSRKLCASDKILEFDRDFRIRHYAGDVVSSWNLLSYPQH

SEQ ID NO: 54296 - protein, 918 aa, Homo sapiens
  Payload ID: 10726
  Gene Symbol: MYO1D
  Gene Name: myosin ID
  ENSP ID: ENSP00000464741
MKRRSKDTCIVISGESGAGKTEASKYIMQYIAAITNPSQRAEVERVKNMLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKEPYYVRCIKPNDKKSPQIFDDERCRHQVEYLGLLENVRVRRAGFAFRQTYEKFLHRYKMISEFTWPNHDLPSDKEAVKKLIERCGFQDDVAYGKTKIFIRTPRTLFTLEELRAQMLIRIVLFLQKVWRGTLARMRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKVNRFSKVEDRAIFVTDRHLYKMDPTKQYKVMKTIPLYNLTGLSVSNGKDQLVVFHTKDNKDLIVCLFSKQPTHESRIGELVGVLVNHFKSEKRHLQVNVTNPVQCSLHGKKCTVSVETRLNQPQPDFTKNRSGFILSVPGN

SEQ ID NO: 54297 - protein, 1108 aa, Homo sapiens
  Payload ID: 10727
  Gene Symbol: MYO1E
  Gene Name: myosin IE
  Uniprot ID: Q12965
  ENSP ID: ENSP00000288235
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGSRQVQFHQGFGDLAVLKPSNKVLQVSIGPGLPKNSRPTRRNTTQNTGYSSGTQNANYPVRAAPPPPGYHQNGVIRNQYVPYPHAPGSQRSNQKSLYTSMARPPLPRQQSTSSDRVSQTPESLDFLKVPDQGAAGVRRQTTSRPPPAGGRPKPQPKPKPQVPQCKALYAYDAQDTDELSFNANDIIDIIKEDPSGWWTGRLRGKQGLFPNNYVTKI

SEQ ID NO: 54298 - protein, 187 aa, Homo sapiens
  Payload ID: 10727
  Gene Symbol: MYO1E
  Gene Name: myosin IE
  ENSP ID: ENSP00000453178
IKQLGKTKEMDVYGITDKQPSLELLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVC

SEQ ID NO: 54299 - protein, 276 aa, Homo sapiens
  Payload ID: 10727
  Gene Symbol: MYO1E
  Gene Name: myosin IE
  ENSP ID: ENSP00000453232
GKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDGVKRDLLLTPKCLYLIGREKVKQGPDKGLVKEVLKRKIEIERILSVSLSTMQDDIFILHEQEYDSLLESVFKTEFLS

SEQ ID NO: 54300 - protein, 112 aa, Homo sapiens
  Payload ID: 10727
  Gene Symbol: MYO1E
  Gene Name: myosin IE
  ENSP ID: ENSP00000453811
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIIST

SEQ ID NO: 54301 - protein, 73 aa, Homo sapiens
  Payload ID: 10727
  Gene Symbol: MYO1E
  Gene Name: myosin IE
  ENSP ID: ENSP00000453936
QTPESLDFLKVPDQGAAGVRRQTTSRPPPAGGRPKPQPKPKPQVRGWGLGAGLLALLSLGLQLECGWPILVCV

SEQ ID NO: 54302 - protein, 317 aa, Homo sapiens
  Payload ID: 10727
  Gene Symbol: MYO1E
  Gene Name: myosin IE
  ENSP ID: ENSP00000454113
  MOD_RES (1)..(1): Any amino acid
XDQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSL

SEQ ID NO: 54303 - protein, 1098 aa, Homo sapiens
  Payload ID: 10728
  Gene Symbol: MYO1F
  Gene Name: myosin IF
  Uniprot ID: O00160
  ENSP ID: ENSP00000344871
MGSKERFHWQSHNVKQSGVDDMVLLPQITEDAIAANLRKRFMDDYIFTYIGSVLISVNPFKQMPYFTDREIDLYQGAAQYENPPHIYALTDNMYRNMLIDCENQCVIISGESGAGKTVAAKYIMGYISKVSGGGEKVQHVKDIILQSNPLLEAFGNAKTVRNNNSSRFGKYFEIQFSRGGEPDGGKISNFLLEKSRVVMQNENERNFHIYYQLLEGASQEQRQNLGLMTPDYYYYLNQSDTYQVDGTDDRSDFGETLSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEAINRAMQKPQEEYSIGVLDIYGFEIFQKNGFEQFCINFVNEKLQQIFIELTLKAEQEEYVQEGIRWTPIQYFNNKVVCDLIENKLSPPGIMSVLDDVCATMHATGGGADQTLLQKLQAAVGTHEHFNSWSAGFVIHHYAGKVSYDVSGFCERNRDVLFSDLIELMQTSEQAFLRMLFPEKLDGDKKGRPSTAGSKIKKQANDLVATLMRCTPHYIRCIKPNETKRPRDWEENRVKHQVEYLGLKENIRVRRAGFAYRRQFAKFLQRYAILTPETWPRWRGDERQGVQHLLRAVNMEPDQYQMGSTKVFVKNPESLFLLEEVRERKFDGFARTIQKAWRRHVAVRKYEEMREEASNILLNKKERRRNSINRNFVGDYLGLEERPELRQFLGKRERVDFADSVTKYDRRFKPIKRDLILTPKCVYVIGREKVKKGPEKGQVCEVLKKKVDIQALRGVSLSTRQDDFFILQEDAADSFLESVFKTEFVSLLCKRFEEATRRPLPLTFSDTLQFRVKKEGWGGGGTRSVTFSRGFGDLAVLKVGGRTLTVSVGDGLPKSSKPTRKGMAKGKPRRSSQAPTRAAPAPPRGMDRNGVPPSARGGPLPLEIMSGGGTHRPPRGPPSTSLGASRRPRARPPSEHNTEFLNVPDQGMAGMQRKRSVGQRPVPGVGRPKPQPRTHGPRCRALYQYVGQDVDELSFNVNEVIEILMEDPSGWWKGRLHGQEGLFPGNYVEKI

SEQ ID NO: 54304 - protein, 295 aa, Homo sapiens
  Payload ID: 10728
  Gene Symbol: MYO1F
  Gene Name: myosin IF
  ENSP ID: ENSP00000469098
PRRSLLRPHRADADQAFLRMLFPEKLDGDKKGRPSTAGSKIKKQANDLVATLMRCTPHYIRCIKPNETKRPRDWEENRTGDSPPRGDSAYPPHQSQAPGGIPGPEGEHQGAQSRLRLPPPVRQIPAEVCHSDPRDVAAVAWGRTPGRPAPASGGQHGARPVPDGEHQGLCQEPRVAFPPGGGARAKVRWLCPNHPEGLAAPRGCPEVRGDAGGSFQHPAEQEGAEAQQHQSELRRGLPGAGGAARAASVPGQEGAGGLRRFGHQVRPPLQAHQAGLDPDAQVCVCDWARESEEGT

SEQ ID NO: 54305 - protein, 118 aa, Homo sapiens
  Payload ID: 10728
  Gene Symbol: MYO1F
  Gene Name: myosin IF
  ENSP ID: ENSP00000469380
KAEQEEYVQEGIRWTPIQYFNNKVVCDLIENKLSPPGIMSVLDDVCATMHATGGGADQTLLQKLQAAVGTHEHFNSWSAGFVIHHYAGKVSYDVSGFCERNRDVLFSDLIELMQTSEQ

SEQ ID NO: 54306 - protein, 76 aa, Homo sapiens
  Payload ID: 10728
  Gene Symbol: MYO1F
  Gene Name: myosin IF
  ENSP ID: ENSP00000469387
MGSKERFHWQSHNVKQSGVDDMVLLPQITEDAIAANLRKRFMDDYIFVPWAKAGDLHRLCAHLCKPLQADALLHRP

SEQ ID NO: 54307 - protein, 134 aa, Homo sapiens
  Payload ID: 10728
  Gene Symbol: MYO1F
  Gene Name: myosin IF
  ENSP ID: ENSP00000469668
MGSKERFHWQSHNVKQSGVDDMVLLPQITEDAIAANLRKRFMDDYIFVPWAKAGGGQQMPYFTDREIDLYQGAAQYENPPHIYALTDNMYRNMLIDCENQCVIISGESGAGKTVAAKYIMGYISKVSGGGEKVQ

SEQ ID NO: 54308 - protein, 1098 aa, Homo sapiens; identical to SEQ ID NO: 54303
  Payload ID: 10728
  Gene Symbol: MYO1F
  Gene Name: myosin IF
  Uniprot ID: O00160
  ENSP ID: ENSP00000481682

SEQ ID NO: 54309 - protein, 1018 aa, Homo sapiens
  Payload ID: 10729
  Gene Symbol: MYO1G
  Gene Name: myosin IG
  Uniprot ID: B0I1T2
  ENSP ID: ENSP00000258787
MEDEEGPEYGKPDFVLLDQVTMEDFMRNLQLRFEKGRIYTYIGEVLVSVNPYQELPLYGPEAIARYQGRELYERPPHLYAVANAAYKAMKHRSRDTCIVISGESGAGKTEASKHIMQYIAAVTNPSQRAEVERVKDVLLKSTCVLEAFGNARTNRNHNSSRFGKYMDINFDFKGDPIGGHIHSYLLEKSRVLKQHVGERNFHAFYQLLRGSEDKQLHELHLERNPAVYNFTHQGAGLNMTVHSALDSDEQSHQAVTEAMRVIGFSPEEVESVHRILAAILHLGNIEFVETEEGGLQKEGLAVAEEALVDHVAELTATPRDLVLRSLLARTVASGGRELIEKGHTAAEASYARDACAKAVYQRLFEWVVNRINSVMEPRGRDPRRDGKDTVIGVLDIYGFEVFPVNSFEQFCINYCNEKLQQLFIQLILKQEQEEYEREGITWQSVEYFNNATIVDLVERPHRGILAVLDEACSSAGTITDRIFLQTLDMHHRHHLHYTSRQLCPTDKTMEFGRDFRIKHYAGDVTYSVEGFIDKNRDFLFQDFKRLLYNSTDPTLRAMWPDGQQDITEVTKRPLTAGTLFKNSMVALVENLASKEPFYVRCIKPNEDKVAGKLDENHCRHQVAYLGLLENVRVRRAGFASRQPYSRFLLRYKMTCEYTWPNHLLGSDKAAVSALLEQHGLQGDVAFGHSKLFIRSPRTLVTLEQSRARLIPIIVLLLQKAWRGTLARWRCRRLRAIYTIMRWFRRHKVRAHLAELQRRFQAARQPPLYGRDLVWPLPPAVLQPFQDTCHALFCRWRARQLVKNIPPSDMPQIKAKVAAMGALQGLRQDWGCRRAWARDYLSSATDNPTASSLFAQRLKTLQDKDGFGAVLFSSHVRKVNRFHKIRNRALLLTDQHLYKLDPDRQYRVMRAVPLEAVTGLSVTSGGDQLVVLHARGQDDLVVCLHRSRPPLDNRVGELVGVLAAHCQGEGRTLEVRVSDCIPLSHRGVRRLISVEPRPEQPEPDFRCARGSFTLLWPSR

SEQ ID NO: 54310 - protein, 42 aa, Homo sapiens
  Payload ID: 10729
  Gene Symbol: MYO1G
  Gene Name: myosin IG
  ENSP ID: ENSP00000417650
MEDEEGPEYGKPDFVLLDQVTMEDFMRNLQLRGEWGREDRSQ

SEQ ID NO: 54311 - protein, 210 aa, Homo sapiens
  Payload ID: 10729
  Gene Symbol: MYO1G
  Gene Name: myosin IG
  ENSP ID: ENSP00000419847
MEDEEGPEYGKPDFVLLDQVTMEDFMRNLQLRFEKGRIYTYIGEVLVSVNPYQELPLYGPEAIARYQGRELYERPPHLYAVANAAYKAMKHRSRDTCIVISGESGAGKTEASKHIMQYIAAVTNPSQRAEVERVKDVLLKSTCVLEAFGNARTNRNHNSSRFGKYMDINFDFKGDPIGGHIHSYLLEKVGSLGSSSSTWVKETSTPSTNC

SEQ ID NO: 54312 - protein, 1038 aa, Homo sapiens
  Payload ID: 10730
  Gene Symbol: MYO1H
  Gene Name: myosin IH
  ENSP ID: ENSP00000439182
MESKKEDVRRKHIRLHMEGALTARDKVGVQDFVLLDAYTSESAFVDNLRKRFSENLIYTYIGTLLVSVNPYQELGIYTVSQMELYQGVNFFELPPHVYAIADNAYRMMCAELNNHFILISGESGAGKTEASKKILEYFAVTCPMTQSLQIARDRLLFSNPVLEAFGNARTLRNDNSSRFGKYMDIQFDFQGIPVGGHIISYLIEKSRVVYQNEGERNFHIFYQLLAGGEEERLSYLGLERDPQLYKYLSQGHCAKESSISDKNDWKTVSNAFSVIDFTEADLENLFGIIASVLHLGNIGFEEDDQGCATIPDTHEIKWIAKLLGVHPSVLLEALTHRKIEAKTEEVICPLTLELSVYARDAMAKAVYGRTFTWLVNKINSSLVNKDFTRKTVIGLLDIYGFEVFDKNGFEQFCINYCNEKLQQLLIERTLKAEQAEYEMEGIEWEPIKYFNNKIICDLVEERHKGIISILDEECIRPGPATDLSFLEKLEEKVGKHAHFETRKLAGPKGRKRIGWMEFRLLHYAGEVTYCTKGFLEKNNDLLYRHLKEVLCKSKNIILRECFLLAELENRRRPPTVGTQFKNSLSSLLETLISKEPSYIRCIKPNDRKEPSKFDDFLIRHQIKYLGLMEHLRVRRAGFAYRRKYEHFLQRYKSLCPDTWPHWHGPPAEGVERLIKYIGYKPEEYKLGKTKIFIRFPRTLFATEDAFEFSKHQLVARIQATYKRCLGRREYVKKRQAAIKLEAHWRGALARKAIQRRKWAVRIIRKFIKGFISRNKPLCPDNEEFIVFVRKNYILNLRYHLPKTVLDKSWLRPPGILENASDLLRKMCVRNLVQKYCRGITAERKAMMQQKVVTSEIFRGRKDGYTESLNQPFVNSRIDEGDINPKVLQLISHEKIQYGVPVIKYDRKGFKARQRQLILTQKAAYVVELAKIKQKIEYSALKGVSTSNLSDGILVIHVSPEDSKQKGDAVLQCGHVFEAVTKLVMLVKKENIVNVVQGSLQFFISPGKEGTIVFDTGLEEQVYKNKNGQLTVVSVRRKS

SEQ ID NO: 54313 - protein, 1022 aa, Homo sapiens
  Payload ID: 10730
  Gene Symbol: MYO1H
  Gene Name: myosin IH
  Uniprot ID: Q8N1T3
  ENSP ID: ENSP00000444076
MEGALTARDKVGVQDFVLLDAYTSESAFVDNLRKRFSENLIYTYIGTLLVSVNPYQELGIYTVSQMELYQGVNFFELPPHVYAIADNAYRMMCAELNNHFILISGESGAGKTEASKKILEYFAVTCPMTQSLQIARDRLLFSNPVLEAFGNARTLRNDNSSRFGKYMDIQFDFQGIPVGGHIISYLIEKSRVVYQNEGERNFHIFYQLLAGGEEERLSYLGLERDPQLYKYLSQGHCAKESSISDKNDWKTVSNAFSVIDFTEADLENLFGIIASVLHLGNIGFEEDDQGCATIPDTHEIKWIAKLLGVHPSVLLEALTHRKIEAKTEEVICPLTLELSVYARDAMAKAVYGRTFTWLVNKINSSLVNKDFTRKTVIGLLDIYGFEVFDKNGFEQFCINYCNEKLQQLLIERTLKAEQAEYEMEGIEWEPIKYFNNKIICDLVEERHKGIISILDEECIRPGPATDLSFLEKLEEKVGKHAHFETRKLAGPKGRKRIGWMEFRLLHYAGEVTYCTKGFLEKNNDLLYRHLKEVLCKSKNIILRECFLLAELENRRRPPTVGTQFKNSLSSLLETLISKEPSYIRCIKPNDRKEPSKFDDFLIRHQIKYLGLMEHLRVRRAGFAYRRKYEHFLQRYKSLCPDTWPHWHGPPAEGVERLIKYIGYKPEEYKLGKTKIFIRFPRTLFATEDAFEFSKHQLVARIQATYKRCLGRREYVKKRQAAIKLEAHWRGALARKAIQRRKWAVRIIRKFIKGFISRNKPLCPDNEEFIVFVRKNYILNLRYHLPKTVLDKSWLRPPGILENASDLLRKMCVRNLVQKYCRGITAERKAMMQQKVVTSEIFRGRKDGYTESLNQPFVNSRIDEGDINPKVLQLISHEKIQYGVPVIKYDRKGFKARQRQLILTQKAAYVVELAKIKQKIEYSALKGVSTSNLSDGILVIHVSPEDSKQKGDAVLQCGHVFEAVTKLVMLVKKENIVNVVQGSLQFFISPGKEGTIVFDTGLEEQVYKNKNGQLTVVSVRRKS

SEQ ID NO: 54314 - protein, 126 aa, Homo sapiens
  Payload ID: 10730
  Gene Symbol: MYO1H
  Gene Name: myosin IH
  ENSP ID: ENSP00000474025
QRQLILTQKAAYVVELAKIKQKIEYSALKGVSTSNLSDGILVIHVSPEDSKQKGDAVLQCGHVFEAVTKLVMLVKKENIVNVVQGSLQFFISPGKEGTIVFDTGLEEQVYKNKNGQLTVVSVRRKS

SEQ ID NO: 54315 - protein, 1616 aa, Homo sapiens
  Payload ID: 10731
  Gene Symbol: MYO3A
  Gene Name: myosin IIIA
  Uniprot ID: Q8NEV4
  ENSP ID: ENSP00000265944
MFPLIGKTIIFDNFPDPSDTWEITETIGKGTYGKVFKVLNKKNGQKAAVKILDPIHDIDEEIEAEYNILKALSDHPNVVRFYGIYFKKDKVNGDKLWLVLELCSGGSVTDLVKGFLKRGERMSEPLIAYILHEALMGLQHLHNNKTIHRDVKGNNILLTTEGGVKLVDFGVSAQLTSTRHRRNTSVGTPFWMAPEVIACEQQLDTTYDARCDTWSLGITAIELGDGDPPLADLHPMRALFKIPRNPPPKLRQPELWSAEFNDFISKCLTKDYEKRPTVSELLQHKFITQIEGKDVMLQKQLTEFIGIHQCMGGTEKARRERIHTKKGNFNRPLISNLKDVDDLATLEILDENTVSEQLEKCYSRDQIYVYVGDILIALNPFQSLGLYSTKHSKLYIGSKRTASPPHIFAMADLGYQSMITYNSDQCIVISGESGAGKTENAHLLVQQLTVLGKANNRTLQEKILQVNNLVEAFGNACTIINDNSSRFGKYLEMKFTSSGAVVGAQISEYLLEKSRVIHQAIGEKNFHIFYYIYAGLAEKKKLAHYKLPENKPPRYLQNDHLRTVQDIMNNSFYKSQYELIEQCFKVIGFTMEQLGSIYSILAAILNVGNIEFSSVATEHQIDKSHISNHTALENCASLLCIRADELQEALTSHCVVTRGETIIRPNTVEKATDVRDAMAKTLYGRLFSWIVNCINSLLKHDSSPSGNGDELSIGILDIFGFENFKKNSFEQLCINIANEQIQYYYNQHVFAWEQNEYLNEDVDARVIEYEDNWPLLDMFLQKPMGLLSLLDEESRFPKATDQTLVEKFEGNLKSQYFWRPKRMELSFGIHHYAGKVLYNASGFLAKNRDTLPTDIVLLLRSSDNSVIRQLVNHPLTKTGNLPHSKTKNVINYQMRTSEKLINLAKGDTGEATRHARETTNMKTQTVASYFRYSLMDLLSKMVVGQPHFVRCIKPNSERQARKYDKEKVLLQLRYTGILETARIRRLGFSHRILFANFIKRYYLLCYKSSEEPRMSPDTCATILEKAGLDNWALGKTKVFLKYYHVEQLNLMRKEAIDKLILIQACVRAFLCSRRYQKIQEKRKESAIIIQSAARGHLVRKQRKEIVDMKNTAVTTIQTSDQEFDYKKNFENTRESFVKKQAENAISANERFISAPNNKGSVSVVKTSTFKPEEETTNAVESNNRVYQTPKKMNNVYEEEVKQEFYLVGPEVSPKQKSVKDLEENSNLRKVEKEEAMIQSYYQRYTEERNCEESKAAYLERKAISERPSYPVPWLAENETSFKKTLEPTLSQRSIYQNANSMEKEKKTSVVTQRAPICSQEEGRGRLRHETVKERQVEPVTQAQEEEDKAAVFIQSKYRGYKRRQQLRKDKMSSFKHQRIVTTPTEVARNTHNLYSYPTKHEEINNIKKKDNKDSKATSEREACGLAIFSKQISKLSEEYFILQKKLNEMILSQQLKSLYLGVSHHKPINRRVSSQQCLSGVCKGEEPKILRPPRRPRKPKTLNNPEDSTYYYLLHKSIQEEKRRPRKDSQGKLLDLEDFYYKEFLPSRSGPKEHSPSLRERRPQQELQNQCIKANERCWAAESPEKEEEREPAANPYDFRRLLRKTSQRRRLVQQS

SEQ ID NO: 54316 - protein, 197 aa, Homo sapiens
  Payload ID: 10731
  Gene Symbol: MYO3A
  Gene Name: myosin IIIA
  ENSP ID: ENSP00000365478
MFPLIGKTIIFDNFPDPSDTWEITETIGKGTYGKVFKVLNKKNGQKAAVKILDPIHDIDEEIEAEYNILKALSDHPNVVRFYGIYFKKDKVNGDKLWLVLELCSGGSVTDLVKGFLKRGERMSEPLIAYILHEALMGLQHLHNNKTIHRDVKGNNILLTTEGGVKLVDFGVSAQLTSTRHRRNTSVGTPFWMAPEVR

SEQ ID NO: 54317 - protein, 247 aa, Homo sapiens
  Payload ID: 10731
  Gene Symbol: MYO3A
  Gene Name: myosin IIIA
  Uniprot ID: Q8NEV4
  ENSP ID: ENSP00000365479
MFPLIGKTIIFDNFPDPSDTWEITETIGKGTYGKVFKVLNKKNGQKAAVKILDPIHDIDEEIEAEYNILKALSDHPNVVRFYGIYFKKDKVNGDKLWLVLELCSGGSVTDLVKGFLKRGERMSEPLIAYILHEALMGLQHLHNNKTIHRDVKGNNILLTTEGGVKLVDFGVSAQLTSTRHRRNTSVGTPFWMAPEVIACEQQLDTTYDARCDTWSLGITAIELGDGDPPLADLHPMRALFKIPRSDD

SEQ ID NO: 54318 - protein, 664 aa, Homo sapiens
  Payload ID: 10731
  Gene Symbol: MYO3A
  Gene Name: myosin IIIA
  ENSP ID: ENSP00000445909
MFPLIGKTIIFDNFPDPSDTWEITETIGKGTYGKVFKVLNKKNGQKAAVKILDPIHDIDEEIEAEYNILKALSDHPNVVRFYGIYFKKDKVNGDKLWLVLELCSGGSVTDLVKGFLKRGERMSEPLIAYILHEALMGLQHLHNNKTIHRDVKGNNILLTTEGGVKLVDFGVSAQLTSTRHRRNTSVGTPFWMAPEVIACEQQLDTTYDARCDTWSLGITAIELGDGDPPLADLHPMRALFKIPRNPPPKLRQPELWSAEFNDFISKCLTKDYEKRPTVSELLQHKFITQIEGKDVMLQKQLTEFIGIHQCMGGTEKARRERIHTKKGNFNRPLISNLKDVDDLATLEILDENTVSEQLEKCYSRDQIYVYVGDILIALNPFQSLGLYSTKHSKLYIGSKRTASPPHIFAMADLGYQSMITYNSDQCIVISGESGAGKTENAHLLVQQLTVLGKANNRTLQEKILQVNNLVEAFGNACTIINDNSSRFGKYLEMKFTSSGAVVGAQISEYLLEKSRVIHQAIGEKNFHIFYYIYAGLAEKKKLAHYKLPENKPPRYLQNDHLRTVQDIMNNSFYKSQYELIEQCFKVIGFTMEVLGGGEPREGGGERASSQPLRLQEAPAQNLPAPAPRPAVLTVQRGSHRRRKALEPAGQQGPSRHSGAGTSRH

SEQ ID NO: 54319 - protein, 1251 aa, Homo sapiens
  Payload ID: 10732
  Gene Symbol: MYO3B
  Gene Name: myosin IIIB
  Uniprot ID: Q8WXR4
  ENSP ID: ENSP00000314650
MKHLYGLFHYNPMMLGLESLPDPTDTWEIIETIGKGTYGKVYKVTNKRDGSLAAVKILDPVSDMDEEIEAEYNILQFLPNHPNVVKFYGMFYKADHCVGGQLWLVLELCNGGSVTELVKGLLRCGQRLDEAMISYILYGALLGLQHLHNNRIIHRDVKGNNILLTTEGGVKLVDFGVSAQLTSTRLRRNTSVGTPFWMAPEVIACEQQYDSSYDARCDVWSLGITAIELGDGDPPLFDMHPVKTLFKIPRNPPPTLLHPEKWCEEFNHFISQCLIKDFERRPSVTHLLDHPFIKGVHGKVLFLQKQLAKVLQDQKHQNPVAKTRHERMHTRRPYHVEDAEKYCLEDDLVNLEVLDEDTIIHQLQKRYADLLIYTYVGDILIALNPFQNLSIYSPQFSRLYHGVKRASNPPHIFASADAAYQCMVTLSKDQCIVISGESGSGKTESAHLIVQHLTFLGKANNQTLREKILQVNSLVEAFGNSCTAINDNSSRFGKYLEMMFTPTGVVMGARISEYLLEKSRVIKQAAREKNFHIFYYIYAGLHHQKKLSDFRLPEEKPPRYIADETGRVMHDITSKESYRRQFEAIQHCFRIIGFTDKEVHSVYRILAGILNIGNIEFAAISSQHQTDKSEVPNAEALQNAASVLCISPEELQEALTSHCVVTRGETIIRANTVDRAADVRDAMSKALYGRLFSWIVNRINTLLQPDENICSAGGGMNVGILDIFGFENFQRNSFEQLCINIANEQIQYYFNQHVFALEQMEYQNEGIDAVPVEYEDNRPLLDMFLQKPLGLLALLDEESRFPQATDQTLVDKFEDNLRCKYFWRPKGVELCFGIQHYAGKVLYDASGVLEKNRDTLPADVVVVLRTSENKLLQQLFSIPLTKTGNLAQTRARITVASSSLPPHFSAGKAKVDTLEVIRHPEETTNMKRQTVASYFRYSLMDLLSKMVVGQPHFVRCIKPNDDREALQFSRERVLAQLRSTGILETVSIRRQGYSHRILFEEFVKRYYYLAFTAHQTPLASKESCVAILEKSRLDHWVLGKTKVFLKYYHVEQLNLLLREVIGRVVVLQAYTKGWLGARRYKRVREKREKGAIAIQSGDTSNQSSGPHSPVAAGTRGSAEVQDCSEPGDHKVLRGSVHRRSHSQAESNNGRTQTSSNSPAVTEKNGHSQAQSSPKGCDIFAGHANKHSVSGTDLLSSRICHPAPDQQGLSLWGAPQKPAFPHYGCNFYGFRKWSCTEASNTSPTMSAAQNAE

SEQ ID NO: 54320 - protein, 1341 aa, Homo sapiens
  Payload ID: 10732
  Gene Symbol: MYO3B
  Gene Name: myosin IIIB
  Uniprot ID: Q8WXR4
  ENSP ID: ENSP00000386213
MKHLYGLFHYNPMMLGLESLPDPTDTWEIIETIGKGTYGKVYKVTNKRDGSLAAVKILDPVSDMDEEIEAEYNILQFLPNHPNVVKFYGMFYKADHCVGGQLWLVLELCNGGSVTELVKGLLRCGQRLDEAMISYILYGALLGLQHLHNNRIIHRDVKGNNILLTTEGGVKLVDFGVSAQLTSTRLRRNTSVGTPFWMAPEVIACEQQYDSSYDARCDVWSLGITAIELGDGDPPLFDMHPVKTLFKIPRNPPPTLLHPEKWCEEFNHFISQCLIKDFERRPSVTHLLDHPFIKGVHGKVLFLQKQLAKVLQDQKHQNPVAKTRHERMHTRRPYHVEDAEKYCLEDDLVNLEVLDEDTIIHQLQKRYADLLIYTYVGDILIALNPFQNLSIYSPQFSRLYHGVKRASNPPHIFASADAAYQCMVTLSKDQCIVISGESGSGKTESAHLIVQHLTFLGKANNQTLREKILQVNSLVEAFGNSCTAINDNSSRFGKYLEMMFTPTGVVMGARISEYLLEKSRVIKQAAREKNFHIFYYIYAGLHHQKKLSDFRLPEEKPPRYIADETGRVMHDITSKESYRRQFEAIQHCFRIIGFTDKEVHSVYRILAGILNIGNIEFAAISSQHQTDKSEVPNAEALQNAASVLCISPEELQEALTSHCVVTRGETIIRANTVDRAADVRDAMSKALYGRLFSWIVNRINTLLQPDENICSAGGGMNVGILDIFGFENFQRNSFEQLCINIANEQIQYYFNQHVFALEQMEYQNEGIDAVPVEYEDNRPLLDMFLQKPLGLLALLDEESRFPQATDQTLVDKFEDNLRCKYFWRPKGVELCFGIQHYAGKVLYDASGVLEKNRDTLPADVVVVLRTSENKLLQQLFSIPLTKTGNLAQTRARITVASSSLPPHFSAGKAKVDTLEVIRHPEETTNMKRQTVASYFRYSLMDLLSKMVVGQPHFVRCIKPNDDREALQFSRERVLAQLRSTGILETVSIRRQGYSHRILFEEFVKRYYYLAFTAHQTPLASKESCVAILEKSRLDHWVLGKTKVFLKYYHVEQLNLLLREVIGRVVVLQAYTKGWLGARRYKRVREKREKGAIAIQSAWRGYDARRKFKKISNRRNESAAHNQAGDTSNQSSGPHSPVAAGTRGSAEVQDCSEPGDHKVLRGSVHRRSHSQAESNNGRTQTSSNSPAVTEKNGHSQAQSSPKGCDIFAGHANKHSVSGTDLLSSRICHPAPDQQGLSLWGAPQKPGSENGLAQKHRTPRRRCQQPKMLSSPEDTMYYNQLNGTLEYQGSKRKPRKLGQIKVLDGEDEYYKSLSPVDCIPEENNSAHPSFFSSSSKGDSFAQH

SEQ ID NO: 54321 - protein, 1314 aa, Homo sapiens
  Payload ID: 10732
  Gene Symbol: MYO3B
  Gene Name: myosin IIIB
  Uniprot ID: Q8WXR4
  ENSP ID: ENSP00000386497
MKHLYGLFHYNPMMLGLESLPDPTDTWEIIETIGKGTYGKVYKVTNKRDGSLAAVKILDPVSDMDEEIEAEYNILQFLPNHPNVVKFYGMFYKADHCVGGQLWLVLELCNGGSVTELVKGLLRCGQRLDEAMISYILYGALLGLQHLHNNRIIHRDVKGNNILLTTEGGVKLVDFGVSAQLTSTRLRRNTSVGTPFWMAPEVIACEQQYDSSYDARCDVWSLGITAIELGDGDPPLFDMHPVKTLFKIPRNPPPTLLHPEKWCEEFNHFISQCLIKDFERRPSVTHLLDHPFIKGVHGKVLFLQKQLAKVLQDQKHQNPVAKTRHERMHTRRPYHVEDAEKYCLEDDLVNLEVLDEDTIIHQLQKRYADLLIYTYVGDILIALNPFQNLSIYSPQFSRLYHGVKRASNPPHIFASADAAYQCMVTLSKDQCIVISGESGSGKTESAHLIVQHLTFLGKANNQTLREKILQVNSLVEAFGNSCTAINDNSSRFGKYLEMMFTPTGVVMGARISEYLLEKSRVIKQAAREKNFHIFYYIYAGLHHQKKLSDFRLPEEKPPRYIADETGRVMHDITSKESYRRQFEAIQHCFRIIGFTDKEVHSVYRILAGILNIGNIEFAAISSQHQTDKSEVPNAEALQNAASVLCISPEELQEALTSHCVVTRGETIIRANTVDRAADVRDAMSKALYGRLFSWIVNRINTLLQPDENICSAGGGMNVGILDIFGFENFQRNSFEQLCINIANEQIQYYFNQHVFALEQMEYQNEGIDAVPVEYEDNRPLLDMFLQKPLGLLALLDEESRFPQATDQTLVDKFEDNLRCKYFWRPKGVELCFGIQHYAGKVLYDASGVLEKNRDTLPADVVVVLRTSENKLLQQLFSIPLTKTGNLAQTRARITVASSSLPPHFSAGKAKVDTLEVIRHPEETTNMKRQTVASYFRYSLMDLLSKMVVGQPHFVRCIKPNDDREALQFSRERVLAQLRSTGILETVSIRRQGYSHRILFEEFVKRYYYLAFTAHQTPLASKESCVAILEKSRLDHWVLGKTKVFLKYYHVEQLNLLLREVIGRVVVLQAYTKGWLGARRYKRVREKREKGAIAIQSGDTSNQSSGPHSPVAAGTRGSAEVQDCSEPGDHKVLRGSVHRRSHSQAESNNGRTQTSSNSPAVTEKNGHSQAQSSPKGCDIFAGHANKHSVSGTDLLSSRICHPAPDQQGLSLWGAPQKPGSENGLAQKHRTPRRRCQQPKMLSSPEDTMYYNQLNGTLEYQGSKRKPRKLGQIKVLDGEDEYYKSLSPVDCIPEENNSAHPSFFSSSSKGDSFAQH

SEQ ID NO: 54322 - protein, 360 aa, Homo sapiens
  Payload ID: 10732
  Gene Symbol: MYO3B
  Gene Name: myosin IIIB
  ENSP ID: ENSP00000401160
  MOD_RES (1)..(1): Any amino acid
XKHLYGLFHYNPMMLGLESLPDPTDTWEIIETIGKGTYGKVYKVTNKRDGSLAAVKILDPVSDMDEEIEAEYNILQFLPNHPNVVKFYGMFYKADHCVGGQLWLVLELCNGGSVTELVKGLLRCGQRLDEAMISYILYGALLGLQHLHNNRIIHRDVKGNNILLTTEGGVKLVDFGVSAQLTSTRLRRNTSVGTPFWMAPEVIACEQQYDSSYDARCDVWSLGITAIELGDGDPPLFDMHPVKTLFKIPRNPPPTLLHPEKWCEEFNHFISQCLIKDFERRPSVTHLLDHPFIKGVHGKVLFLQKQLAKVLQDQKHQNPVAKTRHERMHTRRPYHVEDAEKYCLEDDLVNLEVLDEVLNI

SEQ ID NO: 54323 - protein, 1105 aa, Homo sapiens
  Payload ID: 10732
  Gene Symbol: MYO3B
  Gene Name: myosin IIIB
  ENSP ID: ENSP00000446237
MLQSALLSTRKHLYGLFHYNPMMLGLESLPDPTDTWEIIETIGKGTYGKVYKVTNKRDGSLAAVKILDPVSDMDEEIEAEYNILQFLPNHPNVVKFYGMFYKADHCVGGQLWLVLELCNGGSVTELVKGLLRCGQRLDEAMISYILYGALLGLQHLHNNRIIHRDVKGNNILLTTEGGVKLVDFGVSAQLTSTRLRRNTSVGTPFWMAPEVIACEQQYDSSYDARCDVWSLGITAIELGDGDPPLFDMHPVKTLFKIPRNPPPTLLHPEKWCEEFNHFISQCLIKDFERRPSVTHLLDHPFIKGVHGKVLFLQKQLAKVLQDQKHQNPVAKTRHERMHTRRPYHVEDAEKYCLEDDLVNLEVLDEDTIIHQLQKRYADLLIYTYVGDILIALNPFQNLSIYSPQFSRLYHGVKRASNPPHIFASADAAYQCMVTLSKDQCIVISGESGSGKTESAHLIVQHLTFLGKANNQTLREKILQVNSLVEAFGNSCTAINDNSSRFGKYLEMMFTPTGVVMGARISEYLLEKSRVIKQAAREKNFHIFYYIYAGLHHQKKLSDFRLPEEKPPRYIADETGRVMHDITSKESYRRQFEAIQHCFRIIGFTDKEVHSVYRILAGILNIGNIEFAAISSQHQTDKSEVPNAEALQNAASVLCISPEELQEALTSHCVVTRGETIIRANTVDRAADVRDAMSKALYGRLFSWIVNRINTLLQPDENICSAGGGMNVGILDIFGFENFQRNSFEQLCINIANEQIQYYFNQHVFALEQMEYQNEGIDAVPVEYEDNRPLLDMFLQKPLGLLALLDEESRFPQATDQTLVDKFEDNLRCKYFWRPKGVELCFGIQHYAGKVLYDASGVLEKNRDTLPADVVVVLRTSENKLLQQLFSIPLTKTGNLAQTRARITVASSSLPPHFSAGKAKVDTLEVIRHPEETTNMKRQTVASYFRYSLMDLLSKMVVGQPHFVRCIKPNDDREALQFSRERVLAQLRSTGILETVSIRRQGYSHRILFEEFVKRYYYLAFTAHQTPLASKESCVAILEKSRLDHWVLGKTKVFLKYYHVEQLNLLLREVIGRVVVLQAYTKGWLGARRYKRVREKREKGAIAIQS

SEQ ID NO: 54324 - protein, 2548 aa, Homo sapiens
  Payload ID: 10733
  Gene Symbol: MYO9A
  Gene Name: myosin IXA
  Uniprot ID: B2RTY4
  ENSP ID: ENSP00000348349
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVRIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSGWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQRETSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 54325 - protein, 2548 aa, Homo sapiens; identical to SEQ ID NO: 54324
  Payload ID: 10733
  Gene Symbol: MYO9A
  Gene Name: myosin IXA
  Uniprot ID: B2RTY4
  ENSP ID: ENSP00000398250

SEQ ID NO: 54326 - protein, 729 aa, Homo sapiens
  Payload ID: 10733
  Gene Symbol: MYO9A
  Gene Name: myosin IXA
  Uniprot ID: B2RTY4
  ENSP ID: ENSP00000399162
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGK

SEQ ID NO: 54327 - protein, 1301 aa, Homo sapiens
  Payload ID: 10733
  Gene Symbol: MYO9A
  Gene Name: myosin IXA
  ENSP ID: ENSP00000454446
MEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSKATNPDKLLSHIHLEMETRSILHQGITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVRIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSGWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPL

SEQ ID NO: 54328 - protein, 140 aa, Homo sapiens
  Payload ID: 10733
  Gene Symbol: MYO9A
  Gene Name: myosin IXA
  ENSP ID: ENSP00000454517
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFL

SEQ ID NO: 54329 - protein, 194 aa, Homo sapiens
  Payload ID: 10733
  Gene Symbol: MYO9A
  Gene Name: myosin IXA
  ENSP ID: ENSP00000455150
  MOD_RES (1)..(1): Any amino acid
XLPNPLMTFELYEEFLRAMGLQERKETIRGVYSVIDQLSRTHLNTLERLIFHLVSCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTAD

SEQ ID NO: 54330 - protein, 2396 aa, Homo sapiens
  Payload ID: 10733
  Gene Symbol: MYO9A
  Gene Name: myosin IXA
  ENSP ID: ENSP00000456192
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVRIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSGWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQRETSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSEA

SEQ ID NO: 54331 - protein, 73 aa, Homo sapiens
  Payload ID: 10733
  Gene Symbol: MYO9A
  Gene Name: myosin IXA
  ENSP ID: ENSP00000456882
MNINDGGRRRFEDNEHTLRIYPGAISEGTIYCPIPARKNSTAAEVIESLINKLHLDKTKCYVLAEVKEFGGEE

SEQ ID NO: 54332 - protein, 90 aa, Homo sapiens
  Payload ID: 10733
  Gene Symbol: MYO9A
  Gene Name: myosin IXA
  ENSP ID: ENSP00000457235
  MOD_RES (1)..(1): Any amino acid
XYNPKYVKMYDNHQLGKLEPHIYAVADVAYHAMLQRKKNQCIVISGESGSGKTQSTNFLIHHLTALSQKGFASGVEQIILGAGPVLECLC

SEQ ID NO: 54333 - protein, 463 aa, Homo sapiens
  Payload ID: 10733
  Gene Symbol: MYO9A
  Gene Name: myosin IXA
  ENSP ID: ENSP00000457407
  MOD_RES (1)..(1): Any amino acid
XKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMKPVLIAVRFMNITRNSVSGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 54334 - protein, 1398 aa, Homo sapiens
  Payload ID: 10733
  Gene Symbol: MYO9A
  Gene Name: myosin IXA
  ENSP ID: ENSP00000457945
  MOD_RES (1)..(1): Any amino acid
XSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQREVARPAHKKKARMARTRSDFLTRGTFADGEGDTEEDDYDDIIEPLLSLDQASHCELGPAPSLGQASHSDSEMTSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 54335 - protein, 2022 aa, Homo sapiens
  Payload ID: 10734
  Gene Symbol: MYO9B
  Gene Name: myosin IXB
  Uniprot ID: Q13459
  ENSP ID: ENSP00000380444
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGVEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 54336 - protein, 195 aa, Homo sapiens
  Payload ID: 10734
  Gene Symbol: MYO9B
  Gene Name: myosin IXB
  ENSP ID: ENSP00000469289
HLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKQDITYRLPELDPRGSDEENLDSETSASTESLLEERAGRGASEGQY

SEQ ID NO: 54337 - protein, 59 aa, Homo sapiens
  Payload ID: 10734
  Gene Symbol: MYO9B
  Gene Name: myosin IXB
  ENSP ID: ENSP00000469437
  MOD_RES (1)..(1): Any amino acid
XQERAVSRLHIDESPSRRTLAGACTCVSVSMCAWARLHAYVCVDTCPGAQRARVRQLPG

SEQ ID NO: 54338 - protein, 154 aa, Homo sapiens
  Payload ID: 10734
  Gene Symbol: MYO9B
  Gene Name: myosin IXB
  ENSP ID: ENSP00000470849
  MOD_RES (1)..(1): Any amino acid
XKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRKSKGIKQKQIIPKNLLDSKSLKLI

SEQ ID NO: 54339 - protein, 2157 aa, Homo sapiens
  Payload ID: 10734
  Gene Symbol: MYO9B
  Gene Name: myosin IXB
  ENSP ID: ENSP00000471367
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGVEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKQDITYRLPELDPRGSDEENLDSETSASTESLLEERAGRGASEGPPAPALPCPGAPTPSPLPTVAAPPRRRPSSFVTVRVKTPRRTPIMPTANIKLPPGLPSHLPRWAPGAREAAAPVRRREPPARRPDQIHSVYITPGADLPVQGALEPLEEDGQPPGAKRRYSDPPTYCLPPASGQTNG

SEQ ID NO: 54340 - protein, 2022 aa, Homo sapiens; identical to SEQ ID NO: 54335
  Payload ID: 10734
  Gene Symbol: MYO9B
  Gene Name: myosin IXB
  Uniprot ID: Q13459
  ENSP ID: ENSP00000471457

SEQ ID NO: 54341 - protein, 174 aa, Homo sapiens
  Payload ID: 10734
  Gene Symbol: MYO9B
  Gene Name: myosin IXB
  ENSP ID: ENSP00000472296
TSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKQDITYRLPELDPRGSDEENLDSETSASTESLLEERAGRGASEGHQAHWCNQGADDLRCGKT

SEQ ID NO: 54342 - protein, 174 aa, Homo sapiens
  Payload ID: 10734
  Gene Symbol: MYO9B
  Gene Name: myosin IXB
  ENSP ID: ENSP00000472611
AGRLRAERAEKAAGMSSPGAQSHPEELPRGASTPSEKLYRCSMLDFSFDGSEEFDINAFEDIIAFYESKKKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETV

SEQ ID NO: 54343 - protein, 2071 aa, Homo sapiens
  Payload ID: 10734
  Gene Symbol: MYO9B
  Gene Name: myosin IXB
  ENSP ID: ENSP00000472915
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGVEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNANKSPKTRDIQEEELEVLLEEEAAGGDEDREKEILIERIQSIKEEKEDITYRLPELDPRGSDEENLDSETSASTESLLEERAGRGASEGPPAPALPCPGAPTPSPLPTVAAPPRRRPSSFVTVRVKTPRRTPIMPTANIKLPPGLPSHLPRWAPGA

SEQ ID NO: 54344 - protein, 195 aa, Homo sapiens
  Payload ID: 10734
  Gene Symbol: MYO9B
  Gene Name: myosin IXB
  ENSP ID: ENSP00000472964
  MOD_RES (1)..(1): Any amino acid
XKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNANKSPKTRDIQEEELEVLLEEEAAGGDEDREKEILIERIQSIKEEKQDITYRLPELDPRGSDEENLDSETSASTESLL

SEQ ID NO: 54345 - protein, 1845 aa, Homo sapiens
  Payload ID: 10735
  Gene Symbol: MYLK
  Gene Name: myosin light chain kinase
  Uniprot ID: Q15746
  ENSP ID: ENSP00000320622
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSAPAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEGLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 54346 - protein, 1845 aa, Homo sapiens; identical to SEQ ID NO: 54345
  Payload ID: 10735
  Gene Symbol: MYLK
  Gene Name: myosin light chain kinase
  Uniprot ID: Q15746
  ENSP ID: ENSP00000346846

SEQ ID NO: 54347 - protein, 1863 aa, Homo sapiens
  Payload ID: 10735
  Gene Symbol: MYLK
  Gene Name: myosin light chain kinase
  Uniprot ID: Q15746
  ENSP ID: ENSP00000352088
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSAPAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQLSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 54348 - protein, 1914 aa, Homo sapiens
  Payload ID: 10735
  Gene Symbol: MYLK
  Gene Name: myosin light chain kinase
  Uniprot ID: Q15746
  ENSP ID: ENSP00000353452
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSAPAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQLSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 54349 - protein, 1863 aa, Homo sapiens; identical to SEQ ID NO: 54347
  Payload ID: 10735
  Gene Symbol: MYLK
  Gene Name: myosin light chain kinase
  Uniprot ID: Q15746
  ENSP ID: ENSP00000354004

SEQ ID NO: 54350 - protein, 70 aa, Homo sapiens
  Payload ID: 10735
  Gene Symbol: MYLK
  Gene Name: myosin light chain kinase
  ENSP ID: ENSP00000417798
MGDVKLVASSHISKTSLSVDPSRVDSMPLTEAPAFILPPRNLCIKEGATAKFEGREVLRSSLVSLLFPKP

SEQ ID NO: 54351 - protein, 1914 aa, Homo sapiens; identical to SEQ ID NO: 54348
  Payload ID: 10735
  Gene Symbol: MYLK
  Gene Name: myosin light chain kinase
  Uniprot ID: Q15746
  ENSP ID: ENSP00000418335

SEQ ID NO: 54352 - protein, 229 aa, Homo sapiens
  Payload ID: 10735
  Gene Symbol: MYLK
  Gene Name: myosin light chain kinase
  ENSP ID: ENSP00000422984
MKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPE

SEQ ID NO: 54353 - protein, 154 aa, Homo sapiens
  Payload ID: 10735
  Gene Symbol: MYLK
  Gene Name: myosin light chain kinase
  Uniprot ID: Q15746
  ENSP ID: ENSP00000428967
MAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 54354 - protein, 154 aa, Homo sapiens; identical to SEQ ID NO: 54353
  Payload ID: 10735
  Gene Symbol: MYLK
  Gene Name: myosin light chain kinase
  Uniprot ID: Q15746
  ENSP ID: ENSP00000462118

SEQ ID NO: 54355 - protein, 153 aa, Homo sapiens
  Payload ID: 10735
  Gene Symbol: MYLK
  Gene Name: myosin light chain kinase
  Uniprot ID: Q15746
  ENSP ID: ENSP00000463691
MAMISGLSGRKSSTGSPTSPLNAEKLESEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 54356 - protein, 596 aa, Homo sapiens
  Payload ID: 10736
  Gene Symbol: MYLK2
  Gene Name: myosin light chain kinase 2
  Uniprot ID: Q9H1R3
  ENSP ID: ENSP00000365152
MATENGAVELGIQNPSTDKAPKGPTGERPLAAGKDPGPPDPKKAPDPPTLKKDAKAPASEKGDGTLAQPSTSSQGPKGEGDRGGGPAEGSAGPPAALPQQTATPETSVKKPKAEQGASGSQDPGKPRVGKKAAEGQAAARRGSPAFLHSPSCPAIISSSEKLLAKKPPSEASELTFEGVPMTHSPTDPRPAKAEEGKNILAESQKEVGEKTPGQAGQAKMQGDTSRGIEFQAVPSEKSEVGQALCLTAREEDCFQILDDCPPPPAPFPHRMVELRTGNVSSEFSMNSKEALGGGKFGAVCTCMEKATGLKLAAKVIKKQTPKDKEMVLLEIEVMNQLNHRNLIQLYAAIETPHEIVLFMEYIEGGELFERIVDEDYHLTEVDTMVFVRQICDGILFMHKMRVLHLDLKPENILCVNTTGHLVKIIDFGLARRYNPNEKLKVNFGTPEFLSPEVVNYDQISDKTDMWSMGVITYMLLSGLSPFLGDDDTETLNNVLSGNWYFDEETFEAVSDEAKDFVSNLIVKDQRARMNAAQCLAHPWLNNLAEKAKRCNRRLKSQILLKKYLMKRRWKKNFIAVSAANRFKKISSSGALMALGV

SEQ ID NO: 54357 - protein, 596 aa, Homo sapiens; identical to SEQ ID NO: 54356
  Payload ID: 10736
  Gene Symbol: MYLK2
  Gene Name: myosin light chain kinase 2
  Uniprot ID: Q9H1R3
  ENSP ID: ENSP00000365162

SEQ ID NO: 54358 - protein, 819 aa, Homo sapiens
  Payload ID: 10737
  Gene Symbol: MYLK3
  Gene Name: myosin light chain kinase 3
  Uniprot ID: Q32MK0
  ENSP ID: ENSP00000378288
MSGTSKESLGHGGLPGLGKTCLTTMDTKLNMLNEKVDQLLHFQEDVTEKLQSMCRDMGHLERGLHRLEASRAPGPGGADGVPHIDTQAGWPEVLELVRAMQQDAAQHGARLEALFRMVAAVDRAIALVGATFQKSKVADFLMQGRVPWRRGSPGDSPEENKERVEEEGGKPKHVLSTSGVQSDAREPGEESQKADVLEGTAERLPPIRASGLGADPAQAVVSPGQGDGVPGPAQAFPGHLPLPTKVEAKAPETPSENLRTGLELAPAPGRVNVVSPSLEVAPGAGQGASSSRPDPEPLEEGTRLTPGPGPQCPGPPGLPAQARATHSGGETPPRISIHIQEMDTPGEMLMTGRGSLGPTLTTEAPAAAQPGKQGPPGTGRCLQAPGTEPGEQTPEGARELSPLQESSSPGGVKAEEEQRAGAEPGTRPSLARSDDNDHEVGALGLQQGKSPGAGNPEPEQDCAARAPVRAEAVRRMPPGAEAGSVVLDDSPAPPAPFEHRVVSVKETSISAGYEVCQHEVLGGGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWLNNLPAKASRSKTRLKSQLLLQKYIAQRKWKKHFYVVTAANRLRKFPTSP

SEQ ID NO: 54359 - protein, 478 aa, Homo sapiens
  Payload ID: 10737
  Gene Symbol: MYLK3
  Gene Name: myosin light chain kinase 3
  Uniprot ID: Q32MK0
  ENSP ID: ENSP00000439297
MDTPGEMLMTGRGSLGPTLTTEAPAAAQPGKQGPPGTGRCLQAPGTEPGEQTPEGARELSPLQESSSPGGVKAEEEQRAGAEPGTRPSLARSDDNDHEVGALGLQQGKSPGAGNPEPEQDCAARAPVRAEAVRRMPPGAEAGSVVLDDSPAPPAPFEHRVVSVKETSISAGYEVCQHEVLGGGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWLNNLPAKASRSKTRLKSQLLLQKYIAQRKWKKHFYVVTAANRLRKFPTSP

SEQ ID NO: 54360 - protein, 388 aa, Homo sapiens
  Payload ID: 10738
  Gene Symbol: MYLK4
  Gene Name: myosin light chain kinase family, member 4
  Uniprot ID: Q86YV6
  ENSP ID: ENSP00000274643
MLKVKRLEEFNTCYNSNQLEKMAFFQCREEVEKVKCFLEKNSGDQDSRSGHNEAKEVWSNADLTERMPVKSKRTSALAVDIPAPPAPFDHRIVTAKQGAVNSFYTVSKTEILGGGRFGQVHKCEETATGLKLAAKIIKTRGMKDKEEVKNEISVMNQLDHANLIQLYDAFESKNDIVLVMEYVDGGELFDRIIDESYNLTELDTILFMKQICEGIRHMHQMYILHLDLKPENILCVNRDAKQIKIIDFGLARRYKPREKLKVNFGTPEFLAPEVVNYDFVSFPTDMWSVGVIAYMLLSGLSPFLGDNDAETLNNILACRWDLEDEEFQDISEEAKEFISKLLIKEKSWRISASEALKHPWLSDHKLHSRLNAQKKKNRGSDAQDFVTK

SEQ ID NO: 54361 - protein, 169 aa, Homo sapiens
  Payload ID: 10739
  Gene Symbol: MYLPF
  Gene Name: myosin light chain, phosphorylatable, fast skeletal muscle
  Uniprot ID: Q96A32
  ENSP ID: ENSP00000325239
MAPKRAKRRTVEGGSSSVFSMFDQTQIQEFKEAFTVIDQNRDGIIDKEDLRDTFAAMGRLNVKNEELDAMMKEASGPINFTVFLTMFGEKLKGADPEDVITGAFKVLDPEGKGTIKKKFLEELLTTQCDRFSQEEIKNMWAAFPPDVGGNVDYKNICYVITHGDAKDQE

SEQ ID NO: 54362 - protein, 118 aa, Homo sapiens
  Payload ID: 10739
  Gene Symbol: MYLPF
  Gene Name: myosin light chain, phosphorylatable, fast skeletal muscle
  ENSP ID: ENSP00000454444
MAPKRAKRRTVEGGSSSVFSMFDQTQIQEFKEAFTVIDQNRDGIIDKEDLRDTFAAMGRLNVKNEELDAMMKEASGPINFTVFLTMFGEKLKGADPEDVITGAFKVLDPEGKGTIKKK

SEQ ID NO: 54363 - protein, 135 aa, Homo sapiens
  Payload ID: 10739
  Gene Symbol: MYLPF
  Gene Name: myosin light chain, phosphorylatable, fast skeletal muscle
  ENSP ID: ENSP00000454694
MAPKRAKRRTVEGGSSSVFSMFDQTQIQEFKEAFTVIDQNRDGIIDKEDLRDTFAAMGRLNVKNEELDAMMKEASGPINFTVFLTMFGEKLKGADPEDVITGAFKVLDPEGKGTIKKKFLEELLTTQCDRFSQEE

SEQ ID NO: 54364 - protein, 199 aa, Homo sapiens
  Payload ID: 10739
  Gene Symbol: MYLPF
  Gene Name: myosin light chain, phosphorylatable, fast skeletal muscle
  ENSP ID: ENSP00000455356
APKRAKRRTVEGGSSSVFSMFDQTQIQEFKEAFTVIDQNRDGIIDKEDLRDTFAAMGRLNVKNEELDAMMKEASGPINFTVFLTMFGEKLKGADPEDVITGAFKVLDPEGKGTIKKKFLEELLTTQCDRFSQEEVSGDRGGAGAAKGLGPGRLRACARRPYVFPQIKNMWAAFPPDVGGNVDYKNICYVITHGDAKDQE

SEQ ID NO: 54365 - protein, 1794 aa, Homo sapiens
  Payload ID: 10740
  Gene Symbol: MPRIP
  Gene Name: myosin phosphatase Rho interacting protein
  ENSP ID: ENSP00000317786
  MOD_RES (1)..(1): Any amino acid
XQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQTEVAASPSGAWQRLHRVNQDLQSELEAQCQRQELITHQIQTLKRSYGEAKDTIRHHEAEIRSLQARLSNAAAELAIKEQALAKLKGDLKREQGRVREQLEERQHSEAALSSQLRASEQKLKSAEALLLEKTQELRGLETQQALQRDRQKEVQRLQERIADLSQQLGASEQAQRLMEEKLQRNYELLLESCEKEKQALLQNLKEVEDKASAYEDQLQGQAQQVETLQKEKLSATFEGSEQVHQLEEQLEAREASVRRLAEHVQSLCDERDLLRQRFQELTERVATSDEDVAELREKLRRREADNQSLEHSYQRVSSQLQSMHTLLREKEEELERIKEAHEKVLEKKEQDLNEALVKMVALGSSLEETEIKLQAKEEILRKFASESPKDMEEPRSTPEETERDGTLLPGQPVQATRAPLGLPHTRLEDEDEDLGAPPGEEYGDGSPSREDSMVPPKSVEVLDREGHQQGTAKLDQGAPGVKRQRIRFSTIQCQRYIHPEGSEKTWTSSTSSDTSQDRSPSEESMSSEPAPSVLPATGDSDTYLSIIHSLETKLYVTEEKLKDVTVRLESQQGQSREALLALHHQWAGTEAQLREQLRASLLQVGALASQLEQERQERARRVEGHVGELGDFQVKNSQALMCLENCREQLRSLPRASQEDEQDARAASLASVESALVSAIQALQHWPAPAHGGARAQLETGGTEENGKPASLQQCSQSELTEQEQVRLLSDQIALEASLISQIADSLKNTTSDVSRMLHEISWSGQPPMESAGAPVDTWARKVLVDGEFWSQVESLRKHLGTLGGEAVGASGDGQQSIPQGLAPILANATWVRAELSFATQSVRESFHRRLQSIQETLRGTQTALRQHKCLLREILGAYQTPDFERVMQQVLEALRLPAGHEDGVQLSWDLSPLGEVLGRDSDSSQEPFDVSDQSPGAFVAIQEELAQQLKEKASLLEEIAAALPSLPPVESLRDCQKLLQVSQSLSYNTCLGGLGQYSSLLVQDAIIQAQVCYASCRIRLEYEKELQLCKESWQTREPSCSEQAQAARALREEYEELLRKQKSEYLDVIAIVERENAELKAKAAQLDHQQQCLEDAESKHSMSMFTLRGRYEEEIRCVVEQLTRTESTLQAERSRVLSQLDASVRDRQDMERHHGEQIQTLEDRFQLKVRELQTIHEEELRTLQEHYSQSLRCLQDTLCLHQGPHPKALPAPAPNWQATQGEADSMTGLRERIQELEAQMDVMREELGHKDLEGDAATLREKYQRDLESLKATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 54366 - protein, 1025 aa, Homo sapiens
  Payload ID: 10740
  Gene Symbol: MPRIP
  Gene Name: myosin phosphatase Rho interacting protein
  Uniprot ID: Q6WCQ1
  ENSP ID: ENSP00000342379
MSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSVIEQVSWDT

SEQ ID NO: 54367 - protein, 63 aa, Homo sapiens
  Payload ID: 10740
  Gene Symbol: MPRIP
  Gene Name: myosin phosphatase Rho interacting protein
  ENSP ID: ENSP00000379151
MSAAKENPCRKFQANIFNKSKCQNCFKPRESHLLNDEDLTQQNTHPLEMKRGAHIYDARMFSC

SEQ ID NO: 54368 - protein, 1038 aa, Homo sapiens
  Payload ID: 10740
  Gene Symbol: MPRIP
  Gene Name: myosin phosphatase Rho interacting protein
  Uniprot ID: Q6WCQ1
  ENSP ID: ENSP00000379156
MSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 54369 - protein, 277 aa, Homo sapiens
  Payload ID: 10740
  Gene Symbol: MPRIP
  Gene Name: myosin phosphatase Rho interacting protein
  ENSP ID: ENSP00000411723
  MOD_RES (1)..(1): Any amino acid
XTCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 54370 - protein, 1091 aa, Homo sapiens
  Payload ID: 10740
  Gene Symbol: MPRIP
  Gene Name: myosin phosphatase Rho interacting protein
  ENSP ID: ENSP00000412147
  MOD_RES (1)..(1): Any amino acid
XRFSTIQCQRYIHPEGSEKTWTSSTSSDTSQDRSPSEESMSSEPAPSVLPATGDSDTYLSIIHSLETKLYVTEEKLKDVTVRLESQQGQSREALLALHHQWAGTEAQLREQLRASLLQVGALASQLEQERQERARRVEGHVGELGDFQVKNSQALMCLENCREQLRSLPRASQEDEQDARAASLASVESALVSAIQALQHWPAPAHGGARAQLETGGTEENGKPASLQQCSQSELTEQEQVRLLSDQIALEASLISQIADSLKNTTSDVSRMLHEISWSGQPPMESAGAPVDTWARKVLVDGEFWSQVESLRKHLGTLGGEAVGASGDGQQSIPQGLAPILANATWVRAELSFATQSVRESFHRRLQSIQETLRGTQTALRQHKCLLREILGAYQTPDFERVMQQVLEALRLPAGHEDGVQLSWDLSPLGEVLGRDSDSSQEPFDVSDQSPGAFVAIQEELAQQLKEKASLLEEIAAALPSLPPVESLRDCQKLLQVSQSLSYNTCLGGLGQYSSLLVQDAIIQAQVCYASCRIRLEYEKELQLCKESWQTREPSCSEQAQAARALREEYEELLRKQKSEYLDVIAIVERENAELKAKAAQLDHQQQCLEDAESKHSMSMFTLRGRYEEEIRCVVEQLTRTESTLQAERSRVLSQLDASVRDRQDMERHHGEQIQTLEDRFQLKVRELQTIHEEELRTLQEHYSQSLRCLQDTLCLHQGPHPKALPAPAPNWQATQGEADSMTGLRERIQELEAQMDVMREELGHKDLEGDAATLREKYQRDLESLKATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSVIEQVSWDT

SEQ ID NO: 54371 - protein, 139 aa, Homo sapiens
  Payload ID: 10740
  Gene Symbol: MPRIP
  Gene Name: myosin phosphatase Rho interacting protein
  ENSP ID: ENSP00000462532
MSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVS

SEQ ID NO: 54372 - protein, 844 aa, Homo sapiens
  Payload ID: 10740
  Gene Symbol: MPRIP
  Gene Name: myosin phosphatase Rho interacting protein
  ENSP ID: ENSP00000462688
KKKRKVEPPTPQEPGPAKVAVTSSSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 54373 - protein, 59 aa, Homo sapiens
  Payload ID: 10740
  Gene Symbol: MPRIP
  Gene Name: myosin phosphatase Rho interacting protein
  ENSP ID: ENSP00000463367
  MOD_RES (1)..(1): Any amino acid
XLKDCYLDIMKSKSNPDFLKKDRSCVTRQLRNIRSKSLKEGLTVQERLKLFESRDLKKD

SEQ ID NO: 54374 - protein, 181 aa, Homo sapiens
  Payload ID: 10740
  Gene Symbol: MPRIP
  Gene Name: myosin phosphatase Rho interacting protein
  ENSP ID: ENSP00000464276
  MOD_RES (1)..(1): Any amino acid
XATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKCTTPVLPGNANPELQIRTQTWETPRPEAALLFPALLSSGPVMGYAEPAMCTH

SEQ ID NO: 54375 - protein, 28 aa, Homo sapiens
  Payload ID: 10740
  Gene Symbol: MPRIP
  Gene Name: myosin phosphatase Rho interacting protein
  ENSP ID: ENSP00000464983
  MOD_RES (1)..(1): Any amino acid
XRNWIQTIMKHVHPTTAPDVTSSLNPGT

SEQ ID NO: 54376 - protein, 95 aa, Homo sapiens
  Payload ID: 10740
  Gene Symbol: MPRIP
  Gene Name: myosin phosphatase Rho interacting protein
  ENSP ID: ENSP00000465902
  MOD_RES (1)..(1): Any amino acid
XKKYASDKYKDIYTELSIAKAKADCDISRLKEQLKAATEALGEKSPDSATVSGYDIMKSKSNPDFLKKDRSCVTRQLRNIRSKVSLGSSPLVGGA

SEQ ID NO: 54377 - protein, 264 aa, Homo sapiens
  Payload ID: 10741
  Gene Symbol: MYLIP
  Gene Name: myosin regulatory light chain interacting protein
  ENSP ID: ENSP00000008686
MENYGIEWHSVRDSEGQKLLIGVGPEGISICKDDFSPINRIAYPVVQMATQSGKNVYLTVTKESGNSIVLLFKMISTRAASGLYRAITETHAFYRCDTVTSAVMMQYSRDLKGHLASLFLNENINLGKKYVFDIKRTSKEVYDHARRALYNAGVVDLVSRNNQSPSHSPLKSSESSMNCSSCEGLSCQQTRVLQEKLRKLKEAMLCMVCCEEEINSTFCPCGHTVCCESCAAQLQSCPVCRSRVEHVQHVYLPTHTSLLNLTVI

SEQ ID NO: 54378 - protein, 445 aa, Homo sapiens
  Payload ID: 10741
  Gene Symbol: MYLIP
  Gene Name: myosin regulatory light chain interacting protein
  Uniprot ID: Q8WY64
  ENSP ID: ENSP00000349298
MLCYVTRPDAVLMEVEVEAKANGEDCLNQVCRRLGIIEVDYFGLQFTGSKGESLWLNLRNRISQQMDGLAPYRLKLRVKFFVEPHLILQEQTRHIFFLHIKEALLAGHLLCSPEQAVELSALLAQTKFGDYNQNTAKYNYEELCAKELSSATLNSIVAKHKELEGTSQASAEYQVLQIVSAMENYGIEWHSVRDSEGQKLLIGVGPEGISICKDDFSPINRIAYPVVQMATQSGKNVYLTVTKESGNSIVLLFKMISTRAASGLYRAITETHAFYRCDTVTSAVMMQYSRDLKGHLASLFLNENINLGKKYVFDIKRTSKEVYDHARRALYNAGVVDLVSRNNQSPSHSPLKSSESSMNCSSCEGLSCQQTRVLQEKLRKLKEAMLCMVCCEEEINSTFCPCGHTVCCESCAAQLQSCPVCRSRVEHVQHVYLPTHTSLLNLTVI

SEQ ID NO: 54379 - protein, 1828 aa, Homo sapiens
  Payload ID: 10742
  Gene Symbol: MYO5A
  Gene Name: myosin VA
  Uniprot ID: Q9Y4I1
  ENSP ID: ENSP00000348693
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54380 - protein, 1855 aa, Homo sapiens
  Payload ID: 10742
  Gene Symbol: MYO5A
  Gene Name: myosin VA
  ENSP ID: ENSP00000350945
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILGNKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54381 - protein, 228 aa, Homo sapiens
  Payload ID: 10742
  Gene Symbol: MYO5A
  Gene Name: myosin VA
  ENSP ID: ENSP00000382174
RQELESENKKLKNELNELRKALSEKSAPEVTAPGAPAYRVLMEQLTSVSEELDVRKEEVLILRSQLVSQKEAIQPKNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLYFEELYADDPKKYQSYRISLYKRMI

SEQ ID NO: 54382 - protein, 585 aa, Homo sapiens
  Payload ID: 10742
  Gene Symbol: MYO5A
  Gene Name: myosin VA
  ENSP ID: ENSP00000382175
GAPAYRVLMEQLTSVSEELDVRKEEVLILRSQLVSQKEAIQPKNTMTDSTILLEDVQKMKDKGEIAQAYIGLKETNRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54383 - protein, 1855 aa, Homo sapiens
  Payload ID: 10742
  Gene Symbol: MYO5A
  Gene Name: myosin VA
  Uniprot ID: Q9Y4I1
  ENSP ID: ENSP00000382177
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54384 - protein, 1855 aa, Homo sapiens
  Payload ID: 10742
  Gene Symbol: MYO5A
  Gene Name: myosin VA
  ENSP ID: ENSP00000382179
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKPSQNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54385 - protein, 1853 aa, Homo sapiens
  Payload ID: 10742
  Gene Symbol: MYO5A
  Gene Name: myosin VA
  ENSP ID: ENSP00000451109
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRLLESQLQSQKRSHENEAEALRGEIQSLKEENNRQQQLLAQNLQLPPEARIEASLQHEITRLTNENLYFEELYADDPKKYQSYRISLYKRMIDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54386 - protein, 47 aa, Homo sapiens
  Payload ID: 10742
  Gene Symbol: MYO5A
  Gene Name: myosin VA
  ENSP ID: ENSP00000451178
MAASELYTKFARVWIPDPEEVWKSAELLKDYKPGDKVLLLHLEEGKV

SEQ ID NO: 54387 - protein, 231 aa, Homo sapiens
  Payload ID: 10742
  Gene Symbol: MYO5A
  Gene Name: myosin VA
  ENSP ID: ENSP00000458016
RQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLYFEELYADDPKKYQSYRISLYKRMI

SEQ ID NO: 54388 - protein, 1828 aa, Homo sapiens
  Payload ID: 10742
  Gene Symbol: MYO5A
  Gene Name: myosin VA
  ENSP ID: ENSP00000481420
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILGNKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54389 - protein, 1848 aa, Homo sapiens
  Payload ID: 10743
  Gene Symbol: MYO5B
  Gene Name: myosin VB
  Uniprot ID: Q9ULV0
  ENSP ID: ENSP00000285039
MSVGELYSQCTRVWIPDPDEVWRSAELTKDYKEGDKSLQLRLEDETILEYPIDVQRNQLPFLRNPDILVGENDLTALSYLHEPAVLHNLKVRFLESNHIYTYCGIVLVAINPYEQLPIYGQDVIYTYSGQNMGDMDPHIFAVAEEAYKQMARDEKNQSIIVSGESGAGKTVSAKYAMRYFATVGGSASETNIEEKVLASSPIMEAIGNAKTTRNDNSSRFGKYIQIGFDKRYHIIGANMRTYLLEKSRVVFQADDERNYHIFYQLCAAAGLPEFKELALTSAEDFFYTSQGGDTSIEGVDDAEDFEKTRQAFTLLGVKESHQMSIFKIIASILHLGSVAIQAERDGDSCSISPQDVYLSNFCRLLGVEHSQMEHWLCHRKLVTTSETYVKTMSLQQVINARNALAKHIYAQLFGWIVEHINKALHTSLKQHSFIGVLDIYGFETFEVNSFEQFCINYANEKLQQQFNSHVFKLEQEEYMKEQIPWTLIDFYDNQPCIDLIEAKLGILDLLDEECKVPKGTDQNWAQKLYDRHSSSQHFQKPRMSNTAFIIVHFADKVEYLSDGFLEKNRDTVYEEQINILKASKFPLVADLFHDDKDPVPATTPGKGSSSKISVRSARPPMKVSNKEHKKTVGHQFRTSLHLLMETLNATTPHYVRCIKPNDEKLPFHFDPKRAVQQLRACGVLETIRISAAGYPSRWAYHDFFNRYRVLVKKRELANTDKKAICRSVLENLIKDPDKFQFGRTKIFFRAGQVAYLEKLRADKFRTATIMIQKTVRGWLQKVKYHRLKGATLTLQRYCRGHLARRLAEHLRRIRAAVVLQKHYRMQRARQAYQRVRRAAVVIQAFTRAMFVRRTYRQVLMEHKATTIQKHVRGWMARRHFQRLRDAAIVIQCAFRMLKARRELKALRIEARSAEHLKRLNVGMENKVVQLQRKIDEQNKEFKTLSEQLSVTTSTYTMEVERLKKELVHYQQSPGEDTSLRLQEEVESLRTELQRAHSERKILEDAHSREKDELRKRVADLEQENALLKDEKEQLNNQILCQSKDEFAQNSVKENLMKKELEEERSRYQNLVKEYSQLEQRYDNLRDEMTIIKQTPGHRRNPSNQSSLESDSNYPSISTSEIGDTEDALQQVEEIGLEKAAMDMTVFLKLQKRVRELEQERKKLQVQLEKREQQDSKKVQAEPPQTDIDLDPNADLAYNSLKRQELESENKKLKNDLNELRKAVADQATQNNSSHGSPDSYSLLLNQLKLAHEELEVRKEEVLILRTQIVSADQRRLAGRNAEPNINARSSWPNSEKHVDQEDAIEAYHGVCQTNSKTEDWGYLNEDGELGLAYQGLKQVARLLEAQLQAQSLEHEEEVEHLKAQLEALKEEMDKQQQTFCQTLLLSPEAQVEFGVQQEISRLTNENLDLKELVEKLEKNERKLKKQLKIYMKKAQDLEAAQALAQSERKRHELNRQVTVQRKEKDFQGMLEYHKEDEALLIRNLVTDLKPQMLSGTVPCLPAYILYMCIRHADYTNDDLKVHSLLTSTINGIKKVLKKHNDDFEMTSFWLSNTCRLLHCLKQYSGDEGFMTQNTAKQNEHCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 54390 - protein, 965 aa, Homo sapiens
  Payload ID: 10743
  Gene Symbol: MYO5B
  Gene Name: myosin VB
  ENSP ID: ENSP00000315531
VLMEHKATTIQKHVRGWMARRHFQRLRDAAIVIQCAFRMLKARRELKALRIEARSAEHLKRLNVGMENKVVQLQRKIDEQNKEFKTLSEQLSVTTSTYTMEVERLKKELVHYQQSPGEDTSLRLQEEVESLRTELQRAHSERKILEDAHSREKDELRKRVADLEQENALLKDEKEQLNNQILCQSKDEFAQNSVKENLMKKELEEERSRYQNLVKEYSQLEQRYDNLRDEMTIIKQTPGHRRNPSNQSSLESDSNYPSISTSEIGDTEDALQQVEEIGLEKAAMDMTVFLKLQKRVRELEQERKKLQVQLEKREQQDSKKVQAEPPQTDIDLDPNADLAYNSLKRQELESENKKLKNDLNELRKAVADQATQNNSSHGSPDSYSLLLNQLKLAHEELEVRKEEVLILRTQIVSADQRRLAGRNAEPNINARSSWPNSEKHVDQEDAIEAYHGVCQTNRLLEAQLQAQSLEHEEEVEHLKAQLEALKEEMDKQQQTFCQTLLLSPEAQVEFGVQQEISRLTNENLDLKELVEKLEKNERKLKKQLKIYMKKAQDLEAAQALAQSERKRHELNRQVTVQRKEKDFQGMLEYHKEDEALLIRNLVTDLKPQMLSGTVPCLPAYILYMCIRHADYTNDDLKVHSLLTSTINGIKKVLKKHNDDFEMTSFWLSNTCRLLHCLKQYSGDEGFMTQNTAKQNEHCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 54391 - protein, 418 aa, Homo sapiens
  Payload ID: 10743
  Gene Symbol: MYO5B
  Gene Name: myosin VB
  Uniprot ID: Q9ULV0
  ENSP ID: ENSP00000466368
MKKAQDLEAAQALAQSERKRHELNRQVTVQRKEKDFQGMLEYHKEDEALLIRNLVTDLKPQMLSGTVPCLPAYILYMCIRHADYTNDDLKVHSLLTSTINGIKKVLKKHNDDFEMTSFWLSNTCRLLHCLKQYSGDEGFMTQNTAKQNEHCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 54392 - protein, 720 aa, Homo sapiens
  Payload ID: 10743
  Gene Symbol: MYO5B
  Gene Name: myosin VB
  ENSP ID: ENSP00000479038
MHWPVTRECTRVWIPDPDEVWRSAELTKDYKEGDKSLQLRLEDETILEYPIDVQRNQLPFLRNPDILVGENDLTALSYLHEPAVLHNLKVRFLESNHIYTYCGIVLVAINPYEQLPIYGQDVIYTYSGQNMGDMDPHIFAVAEEAYKQMARDEKNQSIIVSGESGAGKTVSAKYAMRYFATVGGSASETNIEEKVLASSPIMEAIGNAKTTRNDNSSRFGKYIQIGFDKRYHIIGANMRTYLLEKSRVVFQADDERNYHIFYQLCAAAGLPEFKELALTSAEDFFYTSQGGDTSIEGVDDAEDFEKTRQAFTLLGVKESHQMSIFKIIASILHLGSVAIQAERDGDSCSISPQDVYLSNFCRLLGVEHSQMEHWLCHRKLVTTSETYVKTMSLQQVINARNALAKHIYAQLFGWIVEHINKALHTSLKQHSFIGVLDIYGFETFEVNSFEQFCINYANEKLQQQFNSHVFKLEQEEYMKEQIPWTLIDFYDNQPCIDLIEAKLGILDLLDEECKVPKGTDQNWAQKLYDRHSSSQHFQKPRMSNTAFIIVHFADKVEYLSDGFLEKNRDTVYEEQINILKASKFPLVADLFHDDKDPVPATTPGKGSSSKISVRSARPPMKVSNKEHKKTVGHQFRTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 54393 - protein, 1742 aa, Homo sapiens
  Payload ID: 10744
  Gene Symbol: MYO5C
  Gene Name: myosin VC
  Uniprot ID: Q9NQX4
  ENSP ID: ENSP00000261839
MAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQSENERNYHIFYQLCASAQQSEFKHLKLGSAEEFNYTRMGGNTVIEGVNDRAEMVETQKTFTLLGFKEDFQMDVFKILAAILHLGNVQITAVGNERSSVSEDDSHLKVFCELLGLESGRVAQWLCNRKIVTSSETVVKPMTRPQAVNARDALAKKIYAHLFDFIVERINQALQFSGKQHTFIGVLDIYGFETFDVNSFEQFCINYANEKLQQQFNMHVFKLEQEEYMKEDIPWTLIDFYDNQPVIDLIEAKMGILELLDEECLLPHGTDENWLQKLYNNFVNRNPLFEKPRMSNTSFVIQHFADKVEYKCEGFLEKNRDTVYDMLVEILRASKFHLCANFFQENPTPPSPFGSMITVKSAKQVIKPNSKHFRTTVGSKFRSSLYLLMETLNATTPHYVRCIKPNDEKLPFEFDSKRIVQQLRACGVLETIRISAQSYPSRWTYIEFYSRYGILMTKQELSFSDKKEVCKVVLHRLIQDSNQYQFGKTKIFFRAGQVAYLEKLRLDKLRQSCVMVQKHMRGWLQRKKFLRERRAALIIQQYFRGQQTVRKAITAVALKEAWAAIIIQKHCRGYLVRSLYQLIRMATITMQAYSRGFLARRRYRKMLEEHKAVILQKYARAWLARRRFQSIRRFVLNIQLTYRVQRLQKKLEDQNKENHGLVEKLTSLAALRAGDVEKIQKLEAELEKAATHRRNYEEKGKRYRDAVEEKLAKLQKHNSELETQKEQIQLKLQEKTEELKEKMDNLTKQLFDDVQKEERQRMLLEKSFELKTQDYEKQIQSLKEEIKALKDEKMQLQHLVEGEHVTSDGLKAEVARLSKQVKTISEFEKEIELLQAQKIDVEKHVQSQKREMREKMSEITKQLLESYDIEDVRSRLSVEDLEHLNEDGELWFAYEGLKKATRVLESHFQSQKDCYEKEIEALNFKVVHLSQEINHLQKLFREENDINESIRHEVTRLTSENMMIPDFKQQISELEKQKQDLEIRLNEQAEKMKGKLEELSNQLHRSQEEEGTQRKALEAQNEIHTKEKEKLIDKIQEMQEASDHLKKQFETESEVKCNFRQEASRLTLENRDLEEELDMKDRVIKKLQDQVKTLSKTIGKANDVHSSSGPKEYLGMLQYKREDEAKLIQNLILDLKPRGVVVNMIPGLPAHILFMCVRYADSLNDANMLKSLMNSTINGIKQVVKEHLEDFEMLSFWLSNTCHFLNCLKQYSGEEEFMKHNSPQQNKNCLNNFDLSEYRQILSDVAIRIYHQFIIIMEKNIQPIIVPGMLEYESLQGISGLKPTGFRKRSSSIDDTDGYTMTSVLQQLSYFYTTMCQNGLDPELVRQAVKQLFFLIGAVTLNSLFLRKDMCSCRKGMQIRCNISYLEEWLKDKNLQNSLAKETLEPLSQAAWLLQVKKTTDSDAKEIYERCTSLSAVQIIKILNSYTPIDDFEKRVTPSFVRKVQALLNSREDSSQLMLDTKYLFQVTFPFTPSPHALEMIQIPSSFKLGFLNRL

SEQ ID NO: 54394 - protein, 106 aa, Homo sapiens
  Payload ID: 10744
  Gene Symbol: MYO5C
  Gene Name: myosin VC
  ENSP ID: ENSP00000453514
MNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRND

SEQ ID NO: 54395 - protein, 153 aa, Homo sapiens
  Payload ID: 10744
  Gene Symbol: MYO5C
  Gene Name: myosin VC
  ENSP ID: ENSP00000453517
MAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARWEI

SEQ ID NO: 54396 - protein, 269 aa, Homo sapiens
  Payload ID: 10744
  Gene Symbol: MYO5C
  Gene Name: myosin VC
  ENSP ID: ENSP00000453641
MAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQGVPKNLIIQEWEAILSLRV

SEQ ID NO: 54397 - protein, 430 aa, Homo sapiens
  Payload ID: 10744
  Gene Symbol: MYO5C
  Gene Name: myosin VC
  Uniprot ID: Q9NQX4
  ENSP ID: ENSP00000454064
MAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQSENERNYHIFYQLCASAQQSEFKHLKLGSAEEFNYTRMGGNTVIEGVNDRAEMVETQKTFTLLGFKEDFQMDVFKILAAILHLGNVQITAVGNERSSVSEDDSHLKVFCELLGLESGRVAQWLCNRKIVTSSETVVKPMTRPQAVNARDALAKKIYAHLFDFIVERINQALQFSVLKPLM

SEQ ID NO: 54398 - protein, 1253 aa, Homo sapiens
  Payload ID: 10745
  Gene Symbol: MYO6
  Gene Name: myosin VI
  ENSP ID: ENSP00000358992
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRGPAVLATKAAAGTKKYDLSKWKYAELRDTINTSCDIELLAACREEFHRRLKVYHAWKSKNKKRNTETEQRAPKSVTDYAQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 54399 - protein, 1285 aa, Homo sapiens
  Payload ID: 10745
  Gene Symbol: MYO6
  Gene Name: myosin VI
  Uniprot ID: Q9UM54
  ENSP ID: ENSP00000358994
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRNDGTRPKMTPEQMAKEMSEFLSRGPAVLATKAAAGTKKYDLSKWKYAELRDTINTSCDIELLAACREEFHRRLKVYHAWKSKNKKRNTETEQRAPKSVTDYDFAPFLNNSPQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 54400 - protein, 1295 aa, Homo sapiens [sequence omitted]

SEQ ID NO: 54401 - protein, 1262 aa, Homo sapiens
  Payload ID: 10745
  Gene Symbol: MYO6
  Gene Name: myosin VI
  Uniprot ID: Q9UM54
  ENSP ID: ENSP00000359002
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRGPAVLATKAAAGTKKYDLSKWKYAELRDTINTSCDIELLAACREEFHRRLKVYHAWKSKNKKRNTETEQRAPKSVTDYDFAPFLNNSPQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 54402 - protein, 174 aa, Homo sapiens
  Payload ID: 10745
  Gene Symbol: MYO6
  Gene Name: myosin VI
  ENSP ID: ENSP00000399406
KRREEDEKRRRKEEEERRMKLEMEAKRKQEEEERKKREDDEKRIQAEVEAQLARQKEEESQQQAVLEQERRDRELALRIAQSEAELISDEAQADLALRSLDSYPVTSKNDGTRPKMTPGPAVLATKAAAGTKKYDLSKWKYAELRDTINTSCDIELLAACREEFHRRLKVYHAW

SEQ ID NO: 54403 - protein, 1262 aa, Homo sapiens; identical to SEQ ID NO: 54401
  Payload ID: 10745
  Gene Symbol: MYO6
  Gene Name: myosin VI
  Uniprot ID: Q9UM54
  ENSP ID: ENSP00000478013

SEQ ID NO: 54404 - protein, 1294 aa, Homo sapiens
  Payload ID: 10745
  Gene Symbol: MYO6
  Gene Name: myosin VI
  ENSP ID: ENSP00000487348
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRSLDSYPVTSKNDGTRPKMTPEQMAKEMSEFLSRGPAVLATKAAAGTKKYDLSKWKYAELRDTINTSCDIELLAACREEFHRRLKVYHAWKSKNKKRNTETEQRAPKSVTDYDFAPFLNNSPQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 54405 - protein, 2215 aa, Homo sapiens
  Payload ID: 10746
  Gene Symbol: MYO7A
  Gene Name: myosin VIIA
  Uniprot ID: Q13402
  ENSP ID: ENSP00000386331
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRECRVWLSLGCSDLGCAAPHSGWAGLTPAGPCSPCWSCRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 54406 - protein, 2166 aa, Homo sapiens
  Payload ID: 10746
  Gene Symbol: MYO7A
  Gene Name: myosin VIIA
  Uniprot ID: Q13402
  ENSP ID: ENSP00000386635
MDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 54407 - protein, 1178 aa, Homo sapiens
  Payload ID: 10746
  Gene Symbol: MYO7A
  Gene Name: myosin VIIA
  ENSP ID: ENSP00000386689
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRSVPGGGDTRA

SEQ ID NO: 54408 - protein, 2175 aa, Homo sapiens
  Payload ID: 10746
  Gene Symbol: MYO7A
  Gene Name: myosin VIIA
  Uniprot ID: Q13402
  ENSP ID: ENSP00000392185
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 54409 - protein, 1357 aa, Homo sapiens
  Payload ID: 10746
  Gene Symbol: MYO7A
  Gene Name: myosin VIIA
  ENSP ID: ENSP00000417017
FQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRGAKTTAPSFTLATIKGDEYTFTSSNAEDIRDLVVTFLEGLRKRSKYVVALQDNPNPGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 54410 - protein, 1198 aa, Homo sapiens
  Payload ID: 10746
  Gene Symbol: MYO7A
  Gene Name: myosin VIIA
  ENSP ID: ENSP00000477640
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEVLQAQLPEGQKKSSVRHKLVHLTLKKKSKLTEEVTKRLHDGESTVQGNSMLEDRPTSNLEKLHFIIGNGILRTPGPESLLVAEWCLCQPSKRLSRPGFGFAAS

SEQ ID NO: 54411 - protein, 859 aa, Homo sapiens
  Payload ID: 10747
  Gene Symbol: MYRIP
  Gene Name: myosin VIIA and Rab interacting protein
  Uniprot ID: Q8NFW9
  ENSP ID: ENSP00000301972
MGRKLDLSGLTDDETEHVLQVVQRDFNLRKKEEERLSELKQKLDEEGSKCSILSKHQQFVEHCCMRCCSPFTFLVNTKRQCGDCKFNVCKSCCSYQKHEKAWVCCVCQQARLLRAQSLEWFYNNVKSRFKRFGSAKVLKNLYRKHRLESGACFDILGGSLFESNLENEGSISGSDSTFYRQSEGHSVMDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKKFSAVSLCNISTEVLKVINATEELIAGSTGPWESPQVPPDRQKGMFPRGTDQVRLDEQLTSLEENVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 54412 - protein, 770 aa, Homo sapiens
  Payload ID: 10747
  Gene Symbol: MYRIP
  Gene Name: myosin VIIA and Rab interacting protein
  Uniprot ID: Q8NFW9
  ENSP ID: ENSP00000379519
MRKAASAASSRSTSSLWSTAACAAARPSPSSSTPSASVEIANSMSARAAAPTRSTKRPGSAASASKRGGSLFESNLENEGSISGSDSTFYRQSEGHSVMDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKKFSAVSLCNISTEVLKVINATEELIAGSTGPWESPQVPPDRQKGMFPRGTDQVRLDEQLTSLEENVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 54413 - protein, 794 aa, Homo sapiens
  Payload ID: 10747
  Gene Symbol: MYRIP
  Gene Name: myosin VIIA and Rab interacting protein
  Uniprot ID: Q8NFW9
  ENSP ID: ENSP00000389323
MGRKLDLSGLTDDETEHVLQVVQRDFNLRKKEEERLSELKQKLDEEGSKCSILSKHQQFVEHCCMRCCSPFTFLVNTKRQCGDCKFNVCKSCCSYQKHEKAWVCCVCQQARLLRAQSLEWFYNNVKSRFKRFGSAKVLKNLYRKHRLESGACFDILGGSLFESNLENEGSISGSDSTFYRQSEGHSVMDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 54414 - protein, 859 aa, Homo sapiens; identical to SEQ ID NO: 54411
  Payload ID: 10747
  Gene Symbol: MYRIP
  Gene Name: myosin VIIA and Rab interacting protein
  Uniprot ID: Q8NFW9
  ENSP ID: ENSP00000398665

SEQ ID NO: 54415 - protein, 115 aa, Homo sapiens
  Payload ID: 10747
  Gene Symbol: MYRIP
  Gene Name: myosin VIIA and Rab interacting protein
  ENSP ID: ENSP00000400916
MGRKLDLSGLTDDETEHVLQVVQRDFNLRKKEEERLSELKQKLDEEGSKCSILSKHQQFVEHCCMRCCSPFTFLVNTKRQCGDCKFNVCKSCCSYQKHEKAWVCCVCQQARRKPF

SEQ ID NO: 54416 - protein, 637 aa, Homo sapiens
  Payload ID: 10747
  Gene Symbol: MYRIP
  Gene Name: myosin VIIA and Rab interacting protein
  Uniprot ID: Q8NFW9
  ENSP ID: ENSP00000413392
MGRKLDLSGLTDDETEHVLQVVQRDFNLRKKEEERLSELKQKLDEEGSKCSILSKHQQFVEHCCMRCCSPFTFLVNTKRQCGDCKFNVCKSCCSYQKHEKAWVCCVCQQARLLRAQSLEWFYNNVKSRFKRFGSAKVLKNLYRKHRLESGACFDILGGSLFESNLENEGSISGSDSTFYRQSEGHSVMDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKKS

SEQ ID NO: 54417 - protein, 672 aa, Homo sapiens
  Payload ID: 10747
  Gene Symbol: MYRIP
  Gene Name: myosin VIIA and Rab interacting protein
  Uniprot ID: Q8NFW9
  ENSP ID: ENSP00000438297
MDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKKFSAVSLCNISTEVLKVINATEELIAGSTGPWESPQVPPDRQKGMFPRGTDQVRLDEQLTSLEENVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 54418 - protein, 2116 aa, Homo sapiens
  Payload ID: 10748
  Gene Symbol: MYO7B
  Gene Name: myosin VIIB
  Uniprot ID: Q6PIF6
  ENSP ID: ENSP00000386461
MSGFRLGDHVWLEPPSTHKTGVAIGGIIKEAKPGKVLVEDDEGKEHWIRAEDFGVLSPMHPNSVQGVDDMIRLGDLNEAGMVHNLLIRYQQHKIYTYTGSILVAVNPFQVLPLYTLEQVQLYYSRHMGELPPHVFAIANNCYFSMKRNKRDQCCIISGESGAGKTETTKLILQFLATISGQHSWIEQQVLEANPILEAFGNAKTIRNDNSSRFGKYIDIYFNPSGVIEGARIEQFLLEKSRVCRQAPEERNYHIFYCMLMGVSAEDKQLLSLGTPSEYHYLTMGNCTSCEGLNDAKDYAHIRSAMKILQFSDSESWDVIKLLAAILHLGNVGFMASVFENLDASDVMETPAFPTVMKLLEVQHQELRDCLIKHTILIRGEFVTRSLNIAQAADRRDAFVKGIYGHLFLWIVKKINAAIFTPPAQDPKNVRRAIGLLDIFGFENFENNSFEQLCINFANEHLQQFFVQHVFTMEQEEYRSENISWDYIHYTDNRPTLDLLALKPMSIISLLDEESRFPQGTDLTMLQKLNSVHANNKAFLQPKNIHDARFGIAHFAGEVYYQAEGFLEKNRDVLSTDILTLVYSSKNKFLREIFNLELAETKLGHGTIRQAKAGNHLFKSADSNKRPSTLGSQFKQSLDQLMKILTNCQPYFIRCIKPNEYKKPLLFDRELCLRQLRYSGMMETVHIRKSGFPIRYTFEEFSQRFGVLLPNAMRMQLQGKLRQMTLGITDVWLRTDKDWKAGKTKIFLRDHQDTLLEVQRSQVLDRAALSIQKVLRGYRYRKEFLRQRRAAVTLQAWWRGYCNRRNFKLILVGFERLQAIARSQPLARQYQAMRQRTVQLQALCRGYLVRQQVQAKRRAVVVIQAHARGMAARRNFQQRKANAPLVIPAEGQKSQGALPAKKRRSIYDTVTDTEMVEKVFGFLPAMIGGQEGQASPHFEDLESKTQKLLEVDLDTVPMAEEPEEDVDGLAEYTFPKFAVTYFQKSASHTHIRRPLRYPLLYHEDDTDCLAALVIWNVILRFMGDLPEPVLYARSSQQGSSVMRQIHDTLGREHGAQVPQHSRSAQVASQLNIGEEALEPDGLGADRPMSNLEKVHFIVGYAILRPSLRDEIYCQICKQLSENFKTSSLARGWILLSLCLGCFPPSERFMKYLLNFIGQGPATYGPFCAERLRRTYANGVRAEPPTWLELQAVKSKKHIPIQVILATGESLTVPVDSASTSREMCMHIAHKQGLSDHLGFSLQVAVYDKFWSLGSGRDHMMDAIARCEQMAQERGESQRQSPWRIYFRKEFFTPWHDSREDPVSTELIYRQVLRGVWSGEYSFEKEEELVELLARHCYVQLGASAESKAVQELLPSCIPHKLYRTKPPDRWASLVTAACAKAPYTQKQVTPLAVREQVVDAARLQWPLLFSRLFEVITLSGPRLPKTQLILAVNWKGLCFLDQQEKMLLELSFPEVMGLATNREAQGGQRLLLSTMHEEYEFVSPSSVAIAELVALFLEGLKERSIFAMALQDRKATDDTTLLAFKKGDLLVLTKKQGLLASENWTLGQNDRTGKTGLVPMACLYTIPTVTKPSAQLLSLLAMSPEKRKLAAQEGQFTEPRPEEPPKEKLHTLEEFSYEFFRAPEKDMVSMAVLPLARARGHLWAYSCEPLRQPLLKRVHANVDLWDIACQIFVAILRYMGDYPSRQAWPTLELTDQIFTLALQHPALQDEVYCQILKQLTHNSNRHSEERGWQLLWLCTGLFPPSKGLLPHAQKFIDTRRGKLLAPDCSRRIQKVLRTGPRKQPPHQVEVEAAEQNVSRICHKIYFPNDTSEMLEVVANTRVRDVCDSIATRLQLASWEGCSLFIKISDKVISQKEGDFFFDSLREVSDWVKKNKPQKEGAPVTLPYQVYFMRKLWLNISPGKDVNADTILHYHQELPKYLRGFHKCSREDAIHLAGLIYKAQFNNDRSQLASVPKILRELVPENLTRLMSSEEWKKSILLAYDKHKDKTVEEAKVAFLKWICRWPTFGSAFFEVKQTSEPSYPDVILIAINRHGVLLIHPKTKDLLTTYPFTKISSWSSGSTYFHMALGSLGRGSRLLCETSLGYKMDDLLTSYVQQLLSAMNKQRGSKAPALAST

SEQ ID NO: 54419 - protein, 969 aa, Homo sapiens
  Payload ID: 10748
  Gene Symbol: MYO7B
  Gene Name: myosin VIIB
  ENSP ID: ENSP00000386850
MKYLLNFIGQGPATYGPFCAERLRRTYANGVRAEPPTWLELQAVKSKKHIPIQVILATGESLTVPVDSASTSREMCMHIAHKQGLSDHLGFSLQVAVYDKFWSLGSGRDHMMDAIARCEQMAQERGESQRQSPWRIYFRKEFFTPWHDSREDPVSTELIYRQVLRGVWSGEYSFEKEEELVELLARHCYVQLGASAESKAVQELLPSCIPHKLYRTKPPDRWASLVTAACAKAPYTQKQVTPLAVREQVVDAARLQWPLLFSRLFEVITLSGPRLPKTQLILAVNWKGLCFLDQQEKMLLELSFPEVMGLATNREAQGGQRLLLSTMHEEYEFVSPSSVAIAELVALFLEGLKERSIFAMALQDRKATDDTTLLAFKKGDLLVLTKKQGLLASENWTLGQNDRTGKTGLVPMACLYTIPTVTKPSAQLLSLLAMSPEKRKLAAQEGQFTEPRPEEPPKEKLHTLEEFSYEFFRAPEKDMVSMAVLPLARARGHLWAYSCEPLRQPLLKRVHANVDLWDIACQIFVAILRYMGDYPSRQAWPTLELTDQIFTLALQHPALQDEVYCQILKQLTHNSNRHSEERGWQLLWLCTGLFPPSKGLLPHAQKFIDTRRGKLLAPDCSRRIQKVLRTGPRKQPPHQVEVEAAEQNVSRICHKIYFPNDTSEMLEVVANTRVRDVCDSIATRLQLASWEGCSLFIKISDKVISQKEGDFFFDSLREVSDWVKKNKPQKEGAPVTLPYQVYFMRKLWLNISPGKDVNADTILHYHQELPKYLRGFHKCSREDAIHLAGLIYKAQFNNDRSQLASVPKILRELVPENLTRLMSSEEWKKSILLAYDKHKDKTVEEAKVAFLKWICRWPTFGSAFFEVKQTSEPSYPDVILIAINRHGVLLIHPKTKDLLTTYPFTKISSWSSGSTYFHMALGSLGRGSRLLCETSLGYKMDDLLTSYVQQLLSAMNKQRGSKAPALAST

SEQ ID NO: 54420 - protein, 176 aa, Homo sapiens
  Payload ID: 10748
  Gene Symbol: MYO7B
  Gene Name: myosin VIIB
  ENSP ID: ENSP00000404927
MKYLLNFIGQGPATYGPFCAERLRRTYANGVRAEPPTWLELQAVKSKKHIPIQVILATGESLTVPVDSASTSREMCMHIAHKQGLSDHLGFSLQVAVYDKFWSLGSGRDHMMDAIARCEQMAQERGESQRQSPWRIYFRKEFFTPWHDSREDPVSTELIYRQVLRGVWSGEYSFEK

SEQ ID NO: 54421 - protein, 2116 aa, Homo sapiens; identical to SEQ ID NO: 54418
  Payload ID: 10748
  Gene Symbol: MYO7B
  Gene Name: myosin VIIB
  Uniprot ID: Q6PIF6
  ENSP ID: ENSP00000415090

SEQ ID NO: 54422 - protein, 90 aa, Homo sapiens
  Payload ID: 10748
  Gene Symbol: MYO7B
  Gene Name: myosin VIIB
  ENSP ID: ENSP00000456661
  MOD_RES (1)..(1): Any amino acid
XLVIWNVILRFMGDLPEPVLYARSSQQGSSVMRQIHDTLGREHGAQVPQHSRSAQRSGCKDKGTKDISSMKLKRSSRITGQVASQLNIGE

SEQ ID NO: 54423 - protein, 2069 aa, Homo sapiens
  Payload ID: 10749
  Gene Symbol: MYO10
  Gene Name: myosin X
  ENSP ID: ENSP00000274203
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVREVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRQEGAELDSLSFQRVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGSEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 54424 - protein, 1397 aa, Homo sapiens
  Payload ID: 10749
  Gene Symbol: MYO10
  Gene Name: myosin X
  ENSP ID: ENSP00000421170
MLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGSEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 54425 - protein, 2058 aa, Homo sapiens
  Payload ID: 10749
  Gene Symbol: MYO10
  Gene Name: myosin X
  Uniprot ID: Q9HD67
  ENSP ID: ENSP00000421280
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVREVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGSEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 54426 - protein, 830 aa, Homo sapiens
  Payload ID: 10749
  Gene Symbol: MYO10
  Gene Name: myosin X
  ENSP ID: ENSP00000421309
MTSLPRLRLNTRDQAIQLGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVREVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQE

SEQ ID NO: 54427 - protein, 1397 aa, Homo sapiens; identical to SEQ ID NO: 54424
  Payload ID: 10749
  Gene Symbol: MYO10
  Gene Name: myosin X
  ENSP ID: ENSP00000425051

SEQ ID NO: 54428 - protein, 97 aa, Homo sapiens
  Payload ID: 10749
  Gene Symbol: MYO10
  Gene Name: myosin X
  Uniprot ID: Q9HD67
  ENSP ID: ENSP00000426664
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYVQIG

SEQ ID NO: 54429 - protein, 212 aa, Homo sapiens
  Payload ID: 10749
  Gene Symbol: MYO10
  Gene Name: myosin X
  ENSP ID: ENSP00000426783
MDNFFTEVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLL

SEQ ID NO: 54430 - protein, 317 aa, Homo sapiens
  Payload ID: 10750
  Gene Symbol: MYO19
  Gene Name: myosin XIX
  Uniprot ID: Q96H55
  ENSP ID: ENSP00000477559
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVRRKATPLKFGRDDGQPFA

SEQ ID NO: 54431 - protein, 770 aa, Homo sapiens
  Payload ID: 10750
  Gene Symbol: MYO19
  Gene Name: myosin XIX
  Uniprot ID: Q96H55
  ENSP ID: ENSP00000478355
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 54432 - protein, 176 aa, Homo sapiens
  Payload ID: 10750
  Gene Symbol: MYO19
  Gene Name: myosin XIX
  ENSP ID: ENSP00000478381
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSN

SEQ ID NO: 54433 - protein, 770 aa, Homo sapiens; identical to SEQ ID NO: 54431
  Payload ID: 10750
  Gene Symbol: MYO19
  Gene Name: myosin XIX
  Uniprot ID: Q96H55
  ENSP ID: ENSP00000478437

SEQ ID NO: 54434 - protein, 15 aa, Homo sapiens
  Payload ID: 10750
  Gene Symbol: MYO19
  Gene Name: myosin XIX
  ENSP ID: ENSP00000479433
  MOD_RES (1)..(1): Any amino acid
XTPTQNNIFKSSRRG

SEQ ID NO: 54435 - protein, 970 aa, Homo sapiens
  Payload ID: 10750
  Gene Symbol: MYO19
  Gene Name: myosin XIX
  Uniprot ID: Q96H55
  ENSP ID: ENSP00000479518
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEVLSQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 54436 - protein, 183 aa, Homo sapiens
  Payload ID: 10750
  Gene Symbol: MYO19
  Gene Name: myosin XIX
  ENSP ID: ENSP00000479566
MLQQTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVRRKATPLKFGRDDGQPFA

SEQ ID NO: 54437 - protein, 109 aa, Homo sapiens
  Payload ID: 10750
  Gene Symbol: MYO19
  Gene Name: myosin XIX
  ENSP ID: ENSP00000479711
  MOD_RES (1)..(1): Any amino acid
XIRTIRAGRQQQVFRKPCARAECDTRRDCLAKLIYARLFDWLVSVINSSICADTDSWTTFIGSKASLCWEHSRKRAIKPWMERQEPWVHCVTLGSSFPFFVSSCICLPA

SEQ ID NO: 54438 - protein, 44 aa, Homo sapiens
  Payload ID: 10750
  Gene Symbol: MYO19
  Gene Name: myosin XIX
  ENSP ID: ENSP00000479838
MLQQVNGHNPGSDGQAREYLREDLQEFLGGEVLLYKLDDLTRVN

SEQ ID NO: 54439 - protein, 636 aa, Homo sapiens
  Payload ID: 10750
  Gene Symbol: MYO19
  Gene Name: myosin XIX
  Uniprot ID: Q96H55
  ENSP ID: ENSP00000480125
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQQHFVAHYLRAQQEEYAVEGLEWSFINYQDNQPCLDLIEGSPISICSLINEECRLNRPSSAAQLQTRIETALAGSPCLGHNKLSREPSFIVVHYAGPVRYHTAGLVEKNKDPIPPELTRLLQQSQDPLLMGLFPTNPKEKTQEEPPGQSRAPVLTVVSKFKASLEQLLQVLHSTTPHYIRCIKPNSQGQAQTFLQEEA

SEQ ID NO: 54440 - protein, 970 aa, Homo sapiens; identical to SEQ ID NO: 54435
  Payload ID: 10750
  Gene Symbol: MYO19
  Gene Name: myosin XIX
  Uniprot ID: Q96H55
  ENSP ID: ENSP00000480242

SEQ ID NO: 54441 - protein, 186 aa, Homo sapiens
  Payload ID: 10750
  Gene Symbol: MYO19
  Gene Name: myosin XIX
  ENSP ID: ENSP00000481514
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGLSK

SEQ ID NO: 54442 - protein, 65 aa, Homo sapiens
  Payload ID: 10750
  Gene Symbol: MYO19
  Gene Name: myosin XIX
  ENSP ID: ENSP00000482079
MLQQVNGHNPGSDGQAREYLREDLQEFLGGEVLLYKLDDLTRVNPVTLETVLRCLQARYMADTFY

SEQ ID NO: 54443 - protein, 162 aa, Homo sapiens
  Payload ID: 10750
  Gene Symbol: MYO19
  Gene Name: myosin XIX
  ENSP ID: ENSP00000482828
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESH

SEQ ID NO: 54444 - protein, 636 aa, Homo sapiens; identical to SEQ ID NO: 54439
  Payload ID: 10750
  Gene Symbol: MYO19
  Gene Name: myosin XIX
  Uniprot ID: Q96H55
  ENSP ID: ENSP00000487617

SEQ ID NO: 54445 - protein, 44 aa, Homo sapiens; identical to SEQ ID NO: 54438
  Payload ID: 10750
  Gene Symbol: MYO19
  Gene Name: myosin XIX
  ENSP ID: ENSP00000487708

SEQ ID NO: 54446 - protein, 162 aa, Homo sapiens; identical to SEQ ID NO: 54443
  Payload ID: 10750
  Gene Symbol: MYO19
  Gene Name: myosin XIX
  ENSP ID: ENSP00000487967

SEQ ID NO: 54447 - protein, 65 aa, Homo sapiens; identical to SEQ ID NO: 54442
  Payload ID: 10750
  Gene Symbol: MYO19
  Gene Name: myosin XIX
  ENSP ID: ENSP00000487988

SEQ ID NO: 54448 - protein, 15 aa, Homo sapiens
  Payload ID: 10750
  Gene Symbol: MYO19
  Gene Name: myosin XIX
  ENSP ID: ENSP00000487992
  MOD_RES (1)..(1): Any amino acid
XTPTQNNIFKSSRRG

SEQ ID NO: 54449 - protein, 317 aa, Homo sapiens; identical to SEQ ID NO: 54430
  Payload ID: 10750
  Gene Symbol: MYO19
  Gene Name: myosin XIX
  Uniprot ID: Q96H55
  ENSP ID: ENSP00000488204

SEQ ID NO: 54450 - protein, 176 aa, Homo sapiens; identical to SEQ ID NO: 54432
  Payload ID: 10750
  Gene Symbol: MYO19
  Gene Name: myosin XIX
  ENSP ID: ENSP00000488502

SEQ ID NO: 54451 - protein, 109 aa, Homo sapiens; identical to SEQ ID NO: 54437
  Payload ID: 10750
  Gene Symbol: MYO19
  Gene Name: myosin XIX
  ENSP ID: ENSP00000488511
  MOD_RES (1)..(1): Any amino acid

SEQ ID NO: 54452 - protein, 183 aa, Homo sapiens; identical to SEQ ID NO: 54436
  Payload ID: 10750
  Gene Symbol: MYO19
  Gene Name: myosin XIX
  ENSP ID: ENSP00000488557

SEQ ID NO: 54453 - protein, 186 aa, Homo sapiens; identical to SEQ ID NO: 54441
  Payload ID: 10750
  Gene Symbol: MYO19
  Gene Name: myosin XIX
  ENSP ID: ENSP00000488792

SEQ ID NO: 54454 - protein, 3530 aa, Homo sapiens
  Payload ID: 10751
  Gene Symbol: MYO15A
  Gene Name: myosin XVA
  Uniprot ID: Q9UKN7
  ENSP ID: ENSP00000205890
MAKEEDEEKKAKKGKKGKKAPEPEKPKRSLKGTSRLFMGFRDRTPKISKKGQFRSASAFFWGLHTGPQKTKRKRKARTVLKSTSKLMTQMRMGKKKRAMKGKKPSFMVIRFPGRRGYGRLRPRARSLSKASTAINWLTKKFLLKKAEESGSEQATVDAWLQRSSSRMGSRKLPFPSGAEILRPGGRLRRFPRSRSIYASGEPLGFLPFEDEAPFHHSGSRKSLYGLEGFQDLGEYYDYHRDGDDYYDRQSLHRYEEQEPYLAGLGPYSPAWPPYGDHYYGYPPEDPYDYYHPDYYGGPFDPGYTYGYGYDDYEPPYAPPSGYSSPYSYHDGYEGEAHPYGYYLDPYAPYDAPYPPYDLPYHTPYDVPYFDPYGVHYTVPYAEGVYGGGDEAIYPPEVPYFYPEESASAFVYPWVPPPIPSPHNPYAHAMDDIAELEEPEDAGVERQGTSFRLPSAAFFEQQGMDKPARSKLSLIRKFRLFPRPQVKLFGKEKLEVPLPPSLDIPLPLGDADEEEDEEELPPVSAVPYGHPFWGFLTPRQRNLQRALSAFGAHRGLGFGPEFGRPVPRPATSLARFLKKTLSEKKPIARLRGSQKARAGGPAVREAAYKRFGYKLAGMDPEKPGTPIVLRRAQPRARSSNDARRPPAPQPAPRTLSHWSALLSPPVPPRPPSSGPPPAPPLSPALSGLPRPASPYGSLRRHPPPWAAPAHVPPAPQASWWAFVEPPAVSPEVPPDLLAFPGPRPSFRGSRRRGAAFGFPGASPRASRRRAWSPLASPQPSLRSSPGLGYCSPLAPPSPQLSLRTGPFQPPFLPPARRPRSLQESPAPRRAAGRLGPPGSPLPGSPRPPSPPLGLCHSPRRSSLNLPSRLPHTWRRLSEPPTRAVKPQVRLPFHRPPRAGAWRAPLEHRESPREPEDSETPWTVPPLAPSWDVDMPPTQRPPSPWPGGAGSRRGFSRPPPVPENPFLQLLGPVPSPTLQPEDPAADMTRVFLGRHHEPGPGQLTKSAGPTPEKPEEEATLGDPQLPAETKPPTPAPPKDVTPPKDITPPKDVLPEQKTLRPSLSYPLAACDQTRATWPPWHRWGTLPQAAAPLAPIRAPEPLPKGGERRQAAPGRFAVVMPRVQKLSSFQRVGPATLKPQVQPIQDPKPRACSLRWSCLWLRADAYGPWPRVHTHPQSCHLGPGAACLSLRGSWEEVGPPSWRNKMHSIRNLPSMRFREQHGEDGVEDMTQLEDLQETTVLSNLKIRFERNLIYTYIGSILVSVNPYQMFGIYGPEQVQQYNGRALGENPPHLFAVANLAFAKMLDAKQNQCIIISGESGSGKTEATKLILRYLAAMNQKREVMQQIKILEATPLLESFGNAKTVRNDNSSRFGKFVEIFLEGGVISGAITSQYLLEKSRIVFQAKNERNYHIFYELLAGLPAQLRQAFSLQEAETYYYLNQGGNCEIAGKSDADDFRRLLAAMEVLGFSSEDQDSIFRILASILHLGNVYFEKYETDAQEVASVVSAREIQAVAELLQISPEGLQKAITFKVTETMREKIFTPLTVESAVDARDAIAKVLYALLFSWLITRVNALVSPRQDTLSIAILDIYGFEDLSFNSFEQLCINYANENLQYLFNKIVFQEEQEEYIREQIDWQEITFADNQPCINLISLKPYGILRILDDQCCFPQATDHTFLQKCHYHHGANPLYSKPKMPLPEFTIKHYAGKVTYQVHKFLDKNHDQVRQDVLDLFVRSRTRVVAHLFSSHAPQAAPQRLGKSSSVTRLYKAHTVAAKFQQSLLDLVEKMERCNPLFMRCLKPNHKKEPGLFEPDVVMAQLRYSGVLETVRIRKEGFPVRLPFQGFIDRYCCLVALKHDLPANGDMCVSVLSRLCKVMPNMYRVGVSKLFLKEHLYQLLESMREHVLNLAALTLQRCLRGFFIKRRFRSLRHKIILLQSRARGYLARQRYQQMRRSLVKFRSLVHAYVSRRRYLKLRAEWRCQVEGALLWEQEELSKREVVAVGHLEVPAELAGLLQAVAGLGLAQVPQVAPVRTPRLQAEPRVTLPLDINNYPMAKFVQCHFKEPAFGMLTVPLRTPLTQLPAEHHAEAVSIFKLILRFMGDPHLHGARENIFGNYIVQKGLAVPELRDEILAQLANQVWHNHNAHNAERGWLLLAACLSGFAPSPCFNKYLLKFVSDYGRNGFQAVCQHRLMQAMGRAQQQGSGAARTLPPTQLEWTATYEKASMALDVGCFNGDQFSCPVHSWSTGEEVAGDILRHRGLADGWRGWTVAMKNGVQWAELAGHDYVLDLVSDLELLRDFPRQKSYFIVGTEGPAASRGGPKVVFGNSWDSDEDMSTRPQPQEHMPKVLDSDGYSSHNQDGTNGETEAQRGTATHQESDSLGEPAVPHKGLDCYLDSLFDPVLSYGDADLEKPTAIAYRMKGGGQPGGGSSSGTEDTPRRPPEPKPIPGLDASTLALQQAFIHKQAVLLAREMTLQATALQQQPLSAALRSLPAEKPPAPEAQPTSVGTGPPAKPVLLRATPKPLAPAPLAKAPRLPIKPVAAPVLAQDQASPETTSPSPELVRYSTLNSEHFPQPTQQIKNIVRQYQQPFRGGRPEALRKDGGKVFMKRPDPHEEALMILKGQMTHLAAAPGTQVSREAVALVKPVTSAPRPSMAPTSALPSRSLEPPEELTQTRLHRLINPNFYGYQDAPWKIFLRKEVFYPKDSYSHPVQLDLLFRQILHDTLSEACLRISEDERLRMKALFAQNQLDTQKPLVTESVKRAVVSTARDTWEVYFSRIFPATGSVGTGVQLLAVSHVGIKLLRMVKGGQEAGGQLRVLRAYSFADILFVTMPSQNMLEFNLASEKVILFSARAHQVKTLVDDFILELKKDSDYVVAVRNFLPEDPALLAFHKGDIIHLQPLEPPRVGYSAGCVVRRKVVYLEELRRRGPDFGWRFGTIHGRVGRFPSELVQPAAAPDFLQLPTEPGRGRAAAVAAAVASAAAAQEVGRRREGPPVRARSADHGEDALALPPYTMLEFAQKYFRDPQRRPQDGLRLKSKEPRESRTLEDMLCFTKTPLQESLIELSDSSLSKMATDMFLAVMRFMGDAPLKGQSDLDVLCNLLKLCGDHEVMRDECYCQVVKQITDNTSSKQDSCQRGWRLLYIVTAYHSCSEVLHPHLTRFLQDVSRTPGLPFQGIAKACEQNLQKTLRFGGRLELPSSIELRAMLAGRSSKRQLFLLPGGLERHLKIKTCTVALDVVEEICAEMALTRPEAFNEYVIFVVTNRGQHVCPLSRRAYILDVASEMEQVDGGYMLWFRRVLWDQPLKFENELYVTMHYNQVLPDYLKGLFSSVPASRPSEQLLQQVSKLASLQHRAKDHFYLPSVREVQEYIPAQLYRTTAGSTWLNLVSQHRQQTQALSPHQARAQFLGLLSALPMFGSSFFFIQSCSNIAVPAPCILAINHNGLNFLSTETHELMVKFPLKEIQSTRTQRPTANSSYPYVEIALGDVAAQRTLQLQLEQGLELCRVVAVHVENLLSAHEKRLTLPPSEITLL

SEQ ID NO: 54455 - protein, 797 aa, Homo sapiens
  Payload ID: 10751
  Gene Symbol: MYO15A
  Gene Name: myosin XVA
  Uniprot ID: Q9UKN7
  ENSP ID: ENSP00000408800
MKALFAQNQLDTQKPLVTESVKRAVVSTARDTWEVYFSRIFPATGSVGTGVQLLAVSHVGIKLLRMVKGGQEAGGQLRVLRAYSFADILFVTMPSQNMLEFNLASEKVILFSARAHQVKTLVDDFILELKKDSDYVVAVRNFLPEDPALLAFHKGDIIHLQPLEPPRVGYSAGCVVRRKVVYLEELRRRGPDFGWRFGTIHGRVGRFPSELVQPAAAPDFLQLPTEPGRGRAAAVAAAVASAAAAQEVGRRREGPPVRARSADHGEDALALPPYTMLEFAQKYFRDPQRRPQDGLRLKSKEPRESRTLEDMLCFTKTPLQESLIELSDSSLSKMATDMFLAVMRFMGDAPLKGQSDLDVLCNLLKLCGDHEVMRDECYCQVVKQITDNTSSKQDSCQRGWRLLYIVTAYHSCSEVLHPHLTRFLQDVSRTPGLPFQGIAKACEQNLQKTLRFGGRLELPSSIELRAMLAGRSSKRQLFLLPGGLERHLKIKTCTVALDVVEEICAEMALTRPEAFNEYVIFVVTNRGQHVCPLSRRAYILDVASEMEQVDGGYMLWFRRVLWDQPLKFENELYVTMHYNQVLPDYLKGLFSSVPASRPSEQLLQQVSKLASLQHRAKDHFYLPSVREVQEYIPAQLYRTTAGSTWLNLVSQHRQQTQALSPHQARAQFLGLLSALPMFGSSFFFIQSCSNIAVPAPCILAINHNGLNFLSTETHELMVKFPLKEIQSTRTQRPTANSSYPYVEIALGDVAAQRTLQLQLEQVRAGEVLDGRGLSLSPAGTGTVSCGGRARGEPAQCP

SEQ ID NO: 54456 - protein, 153 aa, Homo sapiens
  Payload ID: 10751
  Gene Symbol: MYO15A
  Gene Name: myosin XVA
  ENSP ID: ENSP00000451782
MLCFTKTPLQESLIELSDSSLSKMATDMFLAVMRFMGDAPLKGQSDLDVLCNLLKLCGDHEVMRDECYCQVVKQITDNTSSKQDSCQRGWRLLYIVTAYHSCSEVLHPHLTRFLQDVSRTPGLPFQGIAKACEQNLQKTLRFGGRLELPSSIE

SEQ ID NO: 54457 - protein, 35 aa, Homo sapiens
  Payload ID: 10751
  Gene Symbol: MYO15A
  Gene Name: myosin XVA
  ENSP ID: ENSP00000451925
MLCFTKTPLQESLIELSDSSLSKMATDMFLAVRGP

SEQ ID NO: 54458 - protein, 103 aa, Homo sapiens
  Payload ID: 10751
  Gene Symbol: MYO15A
  Gene Name: myosin XVA
  ENSP ID: ENSP00000464462
MKALFAQNQLDTQKPLVTESVKRAVVSTARDTWEVYFSRIFPATRGHWCAAPSCVPRGHQTPEDGQGWPGGRRAAAGPACIQLCRYPVCDHALPEHAGVQPGQ

SEQ ID NO: 54459 - protein, 257 aa, Homo sapiens
  Payload ID: 10751
  Gene Symbol: MYO15A
  Gene Name: myosin XVA
  ENSP ID: ENSP00000465910
LCNLLKLCGDHEVMRDECYCQVVKQITDNTSSKQDSCQRGWRLLYIVTAYHSCSEVLHPHLTRFLQDVSRTPGLPFQGIAKACEQNLQKTLRFGGRLELPSSIELRAMLAGRSSKRQLFLLPGGLERHLKIKTCTVALDVVEEICAEMALTRPEAFNEYVIFVVTNRGGKSRSTSQPSSTVQRQARPGSTWSASTGSRHRRSAPTRPVPSFWASSAPYLCSAPPSSSSRAAATLLCQPLASLPSTTMASTFSAQRLM

SEQ ID NO: 54460 - protein, 120 aa, Homo sapiens
  Payload ID: 10751
  Gene Symbol: MYO15A
  Gene Name: myosin XVA
  ENSP ID: ENSP00000466630
  MOD_RES (1)..(1): Any amino acid
XSCSEVLHPHLTRFLQDVSRTPGLPFQGIAKACEQNLQKTLRFGGRLELPSSIELRAMLAGRSSKRQLFLLPGGLERHLKIKTCTVALDVVEEICAEMALTRPEAFNEYVIFVVTNRGPA

SEQ ID NO: 54461 - protein, 123 aa, Homo sapiens
  Payload ID: 10751
  Gene Symbol: MYO15A
  Gene Name: myosin XVA
  ENSP ID: ENSP00000467989
MLCFTKTPLQESLIELSDSSLSKMATDMFLAVMRFMGDAPLKGQSDLDVLCNLLKLCGDHEVMRDECYCQVVKQITDNTSSKQDSCQRGWRLLYIVTAYHSCSEVLHPHLTRFLQDVSRTPGL

SEQ ID NO: 54462 - protein, 3530 aa, Homo sapiens
  Payload ID: 10751
  Gene Symbol: MYO15A
  Gene Name: myosin XVA
  ENSP ID: ENSP00000481642
MAKEEDEEKKAKKGKKGKKAPEPEKPKRSLKGTSRLFMGFRDRTPKISKKGQFRSASAFFWGLHTGPQKTKRKRKARTVLKSTSKLMTQMRMGKKKRAMKGKKPSFMVIRFPGRRGYGRLRPRARSLSKASTAINWLTKKFLLKKAEESGSEQATVDAWLQRSSSRMGSRKLPFPSGAEILRPGGRLRRFPRSRSIYASGEPLGFLPFEDEAPFHHSGSRKSLYGLEGFQDLGEYYDYHRDGDDYYDRQSLHRYEEQEPYLAGLGPYSPAWPPYGDHYYGYPPEDPYDYYHPDYYGGPFDPGYTYGYGYDDYEPPYAPPSGYSSPYSYHDGYEGEAHPYGYYLDPYAPYDAPYPPYDLPYHTPYDVPYFDPYGVHYTVPYAEGVYGGGDEAIYPPEVPYFYPEESASAFVYPWVPPPIPSPHNPYAHAMDDIAELEEPEDAGVERQGTSFRLPSAAFFEQQGMDKPARSKLSLIRKFRLFPRPQVKLFGKEKLEVPLPPSLDIPLPLGDADEEEDEEELPPVSAVPYGHPFWGFLTPRQRNLQRALSAFGAHRGLGFGPEFGRPVPRPATSLARFLKKTLSEKKPIARLRGSQKARAGGPAVREAAYKRFGYKLAGMDPEKPGTPIVLRRAQPRARSSNDARRPPAPQPAPRTLSHWSALLSPPVPPRPPSSGPPPAPPLSPALSGLPRPASPYGSLRRHPPPWAAPAHVPPAPQASWWAFVEPPAVSPEVPPDLLAFPGPRPSFRGSRRRGAAFGFPGASPRASRRRAWSPLASPQPSLRSSPGLGYCSPLAPPSPQLSLRTGPFQPPFLPPARRPRSLQESPAPRRAAGRLGPPGSPLPGSPRPPSPPLGLCHSPRRSSLNLPSRLPHTWRRLSEPPTRAVKPQVRLPFHRPPRAGAWRAPLEHRESPREPEDSETPWTVPPLAPSWDVDMPPTQRPPSPWPGGAGSRRGFSRPPPVPENPFLQLLGPVPSPTLQPEDPAADMTRVFLGRHHEPGPGQLTKSAGPTPEKPEEEATLGDPQLPAETKPPTPAPPKDVTPPKDITPPKDVLPEQKTLRPSLSYPLAACDQTRATWPPWHRWGTLPQAAAPLAPIRAPEPLPKGGERRQAAPGRFAVVMPRVQKLSSFQRVGPATLKPQVQPIQDPKPRACSLRWSCLWLRADAYGPWPRVHTHPQSCHLGPGAACLSLRGSWEEVGPPSWRNKMHSIRNLPSMRFREQHGEDGVEDMTQLEDLQETTVLSNLKIRFERNLIYTYIGSILVSVNPYQMFGIYGPEQVQQYNGRALGENPPHLFAVANLAFAKMLDAKQNQCIIISGESGSGKTEATKLILRYLAAMNQKREVMQQVQILEATPLLESFGNAKTVRNDNSSRFGKFVEIFLEGGVISGAITSQYLLEKSRIVFQAKNERNYHIFYELLAGLPAQLRQAFSLQEAETYYYLNQGGNCEIAGKSDADDFRRLLAAMEVLGFSSEDQDSIFRILASILHLGNVYFEKYETDAQEVASVVSAREIQAVAELLQISPEGLQKAITFKVTETMREKIFTPLTVESAVDARDAIAKVLYALLFSWLITRVNALVSPRQDTLSIAILDIYGFEDLSFNSFEQLCINYANENLQYLFNKIVFQEEQEEYIREQIDWQEITFADNQPCINLISLKPYGILRILDDQCCFPQATDHTFLQKCHYHHGANPLYSKPKMPLPEFTIKHYAGKVTYQVHKFLDKNHDQVRQDVLDLFVRSRTRVVAHLFSSHAPQAAPQRLGKSSSVTRLYKAHTVAAKFQQSLLDLVEKMERCNPLFMRCLKPNHKKEPGLFEPDVVMAQLRYSGVLETVRIRKEGFPVRLPFQGFIDRYCCLVALKHDLPANGDMCVSVLSRLCKVMPNMYRVGVSKLFLKEHLYQLLESMREHVLNLAALTLQRCLRGFFIKRRFRSLRHKIILLQSRARGYLARQRYQQMRRSLVKFRSLVHAYVSRRRYLKLRAEWRCQVEGALLWEQEELSKREVVAVGHLEVPAELAGLLQAVAGLGLAQVPQVAPVRTPRLQAEPRVTLPLDINNYPMAKFVQCHFKEPAFGMLTVPLRTPLTQLPAEHHAEAVSIFKLILRFMGDPHLHGARENIFGNYIVQKGLAVPELRDEILAQLANQVWHNHNAHNAERGWLLLAACLSGFAPSPCFNKYLLKFVSDYGRNGFQAVCQHRLMQAMGRAQQQGSGAARTLPPTQLEWTATYEKASMALDVGCFNGDQFSCPVHSWSTGEEVAGDILRHRGLADGWRGWTVAMKNGVQWAELAGHDYVLDLVSDLELLRDFPRQKSYFIVGTEGPAASRGGPKVVFGNSWDSDEDMSTRPQPQEHMPKVLDSDGYSSHNQDGTNGETEAQRGTATHQESDSLGEPAVPHKGLDCYLDSLFDPVLSYGDADLEKPTAIAYRMKGGGQPGGGSSSGTEDTPRRPPEPKPIPGLDASTLALQQAFIHKQAVLLAREMTLQATALQQQPLSAALRSLPAEKPPAPEAQPTSVGTGPPAKPVLLRATPKPLAPAPLAKAPRLPIKPVAAPVLAQDQASPETTSPSPELVRYSTLNSEHFPQPTQQIKNIVRQYQQPFRGGRPEALRKDGGKVFMKRPDPHEEALMILKGQMTHLAAAPGTQVSREAVALVKPVTSAPRPSMAPTSALPSRSLEPPEELTQTRLHRLINPNFYGYQDAPWKIFLRKEVFYPKDSYSHPVQLDLLFRQILHDTLSEACLRISEDERLRMKALFAQNQLDTQKPLVTESVKRAVVSTARDTWEVYFSRIFPATGSVGTGVQLLAVSHVGIKLLRMVKGGQEAGGQLRVLRAYSFADILFVTMPSQNMLEFNLASEKVILFSARAHQVKTLVDDFILELKKDSDYVVAVRNFLPEDPALLAFHKGDIIHLQPLEPPRVGYSAGCVVRRKVVYLEELRRRGPDFGWRFGTIHGRVGRFPSELVQPAAAPDFLQLPTEPGRGRAAAVAAAVASAAAAQEVGRRREGPPVRARSADHGEDALALPPYTMLEFAQKYFRDPQRRPQDGLRLKSKEPRESRTLEDMLCFTKTPLQESLIELSDSSLSKMATDMFLAVMRFMGDAPLKGQSDLDVLCNLLKLCGDHEVMRDECYCQVVKQITDNTSSKQDSCQRGWRLLYIVTAYHSCSEVLHPHLTRFLQDVSRTPGLPFQGIAKACEQNLQKTLRFGGRLELPSSIELRAMLAGRSSKRQLFLLPGGLERHLKIKTCTVALDVVEEICAEMALTRPEAFNEYVIFVVTNRGQHVCPLSRRAYILDVASEMEQVDGGYMLWFRRVLWDQPLKFENELYVTMHYNQVLPDYLKGLFSSVPASRPSEQLLQQVSKLASLQHRAKDHFYLPSVREVQEYIPAQLYRTTAGSTWLNLVSQHRQQTQALSPHQARAQFLGLLSALPMFGSSFFFIQSCSNIAVPAPCILAINHNGLNFLSTETHELMVKFPLKEIQSTRTQRPTANSSYPYVEIALGDVAAQRTLQLQLEQGLELCRVVAVHVENLLSAHEKRLTLPPSEITLL

SEQ ID NO: 54463 - protein, 20 aa, Homo sapiens
  Payload ID: 10752
  Gene Symbol: MYO15B
  Gene Name: myosin XVB
  ENSP ID: ENSP00000487598
  MOD_RES (1)..(1): Any amino acid
XLPVATLEPAPCPPLEPGTQ

SEQ ID NO: 54464 - protein, 1530 aa, Homo sapiens
  Payload ID: 10752
  Gene Symbol: MYO15B
  Gene Name: myosin XVB
  ENSP ID: ENSP00000487744
MKEASGVGGGHSPMCPPHCHMPPGPAGEWPGATVQQPRQRAPTALLQPDAAGPGGGGVSAGVAVLGACPSASEGVLPRPPGRSAPQPPEYPGRPDMAVPGWSAMVRSRLTATSTSQATDHTFLQKSHYHHGDHPSYAKPRLPLPVFTVRHYAGTVTYQVHKFLNRNRDQLDPAVVEMLGQSQLQLVGSLFQEAEPQSRGGRGRPTLASRFQQALEDLIARLGRSHVYFIQCLTPNPGKLPGLFDVGHVTEQLHQAAILEAVGTRSANFPVRVPFEAFLASFQALGSEGQEDLSDREKCGAVLSQVLGAESPLYHLGATKVLLQEQGWQRLEELRDQQRSQALVDLHRSFHTCISRQRVLPRMQARMRGFQARKRYLRRRAALGQLNTILLVAQPLLQRRQRLQLGRWQGWHSSERALERVPSMELGRLEIPAELAVMLKTAESHRDALAGSITECLPPEVPARPSLTLPADIDLFPFSSFVAIGFQEPSLPRPGQPLAKPLTQLDGDNPQRALDINKVMLRLLGDGSLESWQRQIMGAYLVRQGQCRPGLRNELFSQLVAQLWQNPDEQQSQRGWALMAVLLSAFPPLPVLQKPLLKFVSDQAPRGMAALCQHKLLGALEQSQLASGATRAHPPTQLEWLAGWRRGRMALDVFTFSEECYSAEVESWTTGEQLAGWILQSRGLEAPPRGWSVSLHSRDAWQDLAGCDFVLDLISQTEDLGDPARPRSYPITPLGSAEAIPLAPGIQAPSLPPGPPPGPAPTLPSRDHTGEVQRSGSLDGFLDQIFQPVISSGLSDLEQSWALSSRMKGGGAIGPTQQGYPMVYPGMIQMPAYQPGMVPAPMPMMPAMGTVPAMPAMVVPPQPPLPSLDAGQLAVQQQNFIQQQALILAQQMTAQAMSLSLEQQMQQRQQQARASEAASQASPSAVTSKPRKPPTPPEKPQRDLGSEGGCLRETSEEAEDRPYQPKSFQQKRNYFQRMGQPQITVRTMKPPAKVHIPQGEAQEEEEEEEEEEEQEEQEVETRAVPSPPPPPIVKKPLKQGGAKAPKEAEAEPAKETAAKGHGQGPAQGRGTVVRSSDSKPKRPQPSREIGNIIRMYQSRPGPVPVPVQPSRPPKAFLRKIDPKDEALAKLGINGAHSSPPMLSPSPGKGPPPAVAPRPKAPLQLGPSSSIKEKQGPLLDLFGQKLPIAHTPPPPPAPPLPLPEDPGTLSAERRCLTQPVEDQGVSTQLLAPSGSVCFSYTGTPWKLFLRKEVFYPRENFSHPYYLRLLCEQILRDTFSESCIRISQNERRKMKDLLGGLEVDLDSLTTTEDSVKKRIVVAARDNWANYFSRFFPVSGESGSDVQLLAVSHRGLRLLKVTQGPGLRPDQLKILCSYSFAEVLGVECRGGSTLELSLKSEQLVLHTARARAIEALVELFLNELKKDSGYVIALRSYITDNCSLLSFHRGDLIKLLPVATLEPGWQFGSAGGRSGLFPADIVQPAAAPDFSFSKEQRSGWHKGQLSNGEPGLARWDRASEVRKMGEGQAEARPA

SEQ ID NO: 54465 - protein, 278 aa, Homo sapiens
  Payload ID: 10752
  Gene Symbol: MYO15B
  Gene Name: myosin XVB
  ENSP ID: ENSP00000487752
  MOD_RES (1)..(1): Any amino acid
XATSLSSVAYAFLPDSHSYTMQEFARRYFRRSQALLGQTDGGAAGKDTDSLVQYTKAPIQESLLSLSDDVSKLAVASFLALMRFMGDQSKPRGKDEMDLLYELLKLCQQEKLRDEIYCQVIKQVTGHPRPLMPYLTKFLQDSGPSQELARSSQEHLQRTVKYGGRRRMPPPGEMKAFLKGQAIRLLLIHLPGGVDYRTNIQTFTVAAEVQEELCRQMGITEPQEVQEFALFLIKEKSQLVRPLQPAEYLNSVVVDQDVSLHSRRLHWETPLHFDNSTY

SEQ ID NO: 54466 - protein, 1543 aa, Homo sapiens
  Payload ID: 10752
  Gene Symbol: MYO15B
  Gene Name: myosin XVB
  ENSP ID: ENSP00000487811
MGRNQRKAPQRLERPGRPASGEQESGSASADGAPSRERRSDRGQADRAKPAAEPATAGGQGTPGGRRKPTAEGNGGCRRPGAGLSPKAQERQSNAQRQGRGPRGGRGGRLEEGSLSGGEELGGRRRRKRKDKGPSARRGRRTPRSLNGDTSGGDGGSSCPDSETREAQESGSQRGTARELRPTPEPTDMGSEGTKTGPESALEPSSDGLDSDWPHADTRGREGSSGTGPLGASEHSGGDSDSSPLGTGPGRGSRAAMASRTFEDSSRAPRDTGPAKDASDNRAQRGAEPETMQASTARAPRHQVGKAVGQVPAAAGEGEAGAAAGAGPEDPAPLAALLVVRRLLARPPPGAASQAVGPRRAGLKERLLSVARALGLLRWLRRRLRLRRRPPEGEGQGTGPRASEGWGRRKPDEGRGHGRGSKGRGRGKADEGRGHERGDEGRGRGKADEGRGHERGYEGRGCGKADEGRGHERGDEGRDHQRGYEGWGREPGLRHRLALRLAGLAGLGGMPRASPGGRSPQVPTSPVPGDPFDQEDETPDPKFAVVFPRIHRAGRASSSRSSEEASADAPTGEGRGWPRAGVGGHSEGCRTSGEGVSGLRRGSLLAPTAPDGPSLDESGSSSEAELETLNDEPPVRWAQGSGPHEGPRLGAAVLLPRLSLETRLQQEGDPGLRGSLRELWEPEDEDEAVLERDLELSLRPGLEAPPFPGAKGRSLGDGLEDMEDLARLRHIFAIVASAYDLAQNTGQDPCILLCGHSGSGKTEAAKKIMQFLSSLEQDQTGNRECQVEDMLPILSSFGHAKTILNANASRFGQVFCLYLQQGVIVGASVSHYLLETSRVVFQAQAERSFHVFYKLLAGLDSIERERLSLQGPETYYYLNQGQACRLQGKEDAQDFEGLLKALQGLGLCPEELNAVWAVLAAILQLGNICFSSSERESQEVAAVSSWAEIHTAARLLRVPPECLEGAVTRRVTETPYGQVSRSLPVESAFDARDALAKALYSRLFHRLLRRTNARLAPPGEGGSIGTVTVVDAYGFEALRVNGLEQLCNNLASERLQLFSSQMLLAQEEPPRESCLDLLVDQPHSLLSILDAQTWLSQATDHTFLQKSHYHHGDHPSYAKPRLPLPVFTVRHYAGTVTYQVHKFLNRNRDQLDPAVVEMLGQSQLQLVGSLFQEAEPQSRGGRGRPTLASRFQQALEDLIARLGRSHVYFIQCLTPNPGKLPGLFDVGHVTEQLHQAAILEAVGTRSANFPVRVPFEAFLASFQALGSEGQEDLSDREKCGAVLSQVLGAESPLYHLGATKVLLQEQGWQRLEELRDQQRSQALVDLHRSFHTCISRQRVLPRMQARMRGFQARSAGVGARAEVGGPVFTHSSNSCWLTVCLIYPWARCWKRYLRRRAALGQLNTILLVAQPLLQRRQRLQELGRLEIPAELAVMLKTAESHRDALAGSITECLPPEVPARPSLTLPADIDLFPFSSFVAIGFQARAATGEAPNPAGWRQPSACPGHQQSDAAAPGGRIPGVLAEADHGRIPGAAGAVPARAAE

SEQ ID NO: 54467 - protein, 760 aa, Homo sapiens
  Payload ID: 10752
  Gene Symbol: MYO15B
  Gene Name: myosin XVB
  ENSP ID: ENSP00000487864
MGRNQRKAPQRLERPGRPASGEQESGSASADGAPSRERRSDRGQADRAKPAAEPATAGGQGTPGGRRKPTAEGNGGCRRPGAGLSPKAQERQSNAQRQGRGPRGGRGGRLEEGSLSGGEELGGRRRRKRKDKGPSARRGRRTPRSLNGDTSGGDGGSSCPDSETREAQESGSQRGTARELRPTPEPTDMGSEGTKTGPESALEPSSDGLDSDWPHADTRGREGSSGTGPLGASEHSGGDSDSSPLGTGPGRGSRAAMASRTFEDSSRAPRDTGPAKDASDNRAQRGAEPETMQASTARAPRHQVGKAVGQVPAAAGEGEAGAAAGAGPEDPAPLAALLVVRRLLARPPPGAASQAVGPRRAGLKERLLSVARALGLLRWLRRRLRLRRRPPEGEGQGTGPRASEGWGRRKPDEGRGHGRGSKGRGRGKADEGRGHERGDEGRGRGKADEGRGHERGYEGRGCGKADEGRGHERGDEGRDHQRGYEGWGREPGLRHRLALRLAGLAGLGGMPRASPGGRSPQVPTSPVPGDPFDQEDETPDPKFAVVFPRIHRAGRASSSRSSEEASADAPTGEGRGWPRAGVGGHSEGCRTSGEGVSGLRRGSLLAPTAPDGPSLDESGSSSEAELETLNDEPPVRWAQGSGPHEGPRLGAAVLLPRLSLETRLQQEGDPGLRGSLRELWEPEDEDEAVLERDLELSLRPGLEAPPFPGAKGRSLGDGLEDMEDLARLRLAGAVPKLPSPAHSSSYPPCPHLYELRVDPY

SEQ ID NO: 54468 - protein, 66 aa, Homo sapiens
  Payload ID: 10752
  Gene Symbol: MYO15B
  Gene Name: myosin XVB
  ENSP ID: ENSP00000487895
TKVLLQEQGWQRLEELRDQQRSQALVDLHRSFHTCISRQRVLPRMQARMRGFQASLSSHIPPTAVG

SEQ ID NO: 54469 - protein, 112 aa, Homo sapiens
  Payload ID: 10752
  Gene Symbol: MYO15B
  Gene Name: myosin XVB
  ENSP ID: ENSP00000487954
CNNLASERLQLFSSQMLLAQEEEECRRELLSWVPVPQPPRESCLDLLVDQPHSLLSILDAQTWLSQTEFGSCCPGWSAMVRSRLTATSTSQATDHTFLQKSHYHHGDHPSYA

SEQ ID NO: 54470 - protein, 256 aa, Homo sapiens
  Payload ID: 10752
  Gene Symbol: MYO15B
  Gene Name: myosin XVB
  ENSP ID: ENSP00000488194
VHKFLNRNRDQLDPAVVEMLGQSQLQLVGSLFQEAEPQSRGGRGRPTLASRFQQALEDLIARLGRSHVYFIQCLTPNPGKLPGLFDVGHVTEQLHQAAILEAVGTRSANFPVRVPFEAFLASFQALGSEGQEDLSDREKCGAVLSQVLGAESPLYHLGATKVLLQEQGWQRLEELRDQQRSQALVDLHRSFHTCISRQRVLPRMQARMRGFQARKRYLRRRAALGQLNTILLVAQPLLQRRQRLQLGRWQGWHSSE

SEQ ID NO: 54471 - protein, 192 aa, Homo sapiens
  Payload ID: 10752
  Gene Symbol: MYO15B
  Gene Name: myosin XVB
  ENSP ID: ENSP00000488226
  MOD_RES (1)..(1): Any amino acid
XKQVTGHPRPEHCTRGWSFLSLLTGFFPPSTRLMPYLTKFLQDSGPSQELARSSQEHLQRTVKYGGRRRMPPPGEMKAFLKGQAIRLLLIHLPGGVDYRTNIQTFTVAAEVQEELCRQMGITEPQEVQEFALFLIKEKSKLGDGASRWGHSPAQGPAGAAPAARRIPQQRGSGPGREPAQPAAPLGDPTALR

SEQ ID NO: 54472 - protein, 85 aa, Homo sapiens
  Payload ID: 10752
  Gene Symbol: MYO15B
  Gene Name: myosin XVB
  ENSP ID: ENSP00000488316
  MOD_RES (1)..(1): Any amino acid
XPKRPQPSREIGNIIRMYQSRPGPVPVPVQPSSFPEENRPQGRGSGQAGYQRCPLVPADAVPQPRKGPPASCGSSTQGPATAWAL

SEQ ID NO: 54473 - protein, 156 aa, Homo sapiens
  Payload ID: 10752
  Gene Symbol: MYO15B
  Gene Name: myosin XVB
  ENSP ID: ENSP00000488354
  MOD_RES (1)..(1): Any amino acid
XFAEVLGVECRGGSTLELSLKSEQLVLHTARARAIEALVELFLNELKKDSGYVIALRSYITDNCSLLSFHRGDLIKLLPVATLEPGWQFGSAGGRSGLFPADIVQPAAAPDFSFSKEQRSGWHKGQLSNGEPGLARWDRASEVRKMGEGQAEARPA

SEQ ID NO: 54474 - protein, 103 aa, Homo sapiens
  Payload ID: 10752
  Gene Symbol: MYO15B
  Gene Name: myosin XVB
  ENSP ID: ENSP00000488398
QEKLRDEIYCQVIKQVTGHPRPEHCTRGWSFLSLLTGFFPPSTRLMPYLTKFLQDSGPSQELARSSQEHLQRTVKYGGRRRMPPPERTSDSPASYSPAGGCGL

SEQ ID NO: 54475 - protein, 105 aa, Homo sapiens
  Payload ID: 10752
  Gene Symbol: MYO15B
  Gene Name: myosin XVB
  ENSP ID: ENSP00000488495
  MOD_RES (1)..(1): Any amino acid
XAYQPGMVPAPMPMMPAMGTVPAMPATASQPGCRAAGRPAAELYPAAGANPGPADDSPGHVPVPGAADAAAAAAGSGLRGCVPGLTLSRHLQAQEAPHTPGEATA

SEQ ID NO: 54476 - protein, 72 aa, Homo sapiens
  Payload ID: 10752
  Gene Symbol: MYO15B
  Gene Name: myosin XVB
  ENSP ID: ENSP00000488510
  MOD_RES (1)..(1): Any amino acid
XQDVSLHSRRLHWETPLHFDNSTYISTHYSQVLWDYLQGKLPVSAKADAQLARLAALQHLSKANRNTPSGTC

SEQ ID NO: 54477 - protein, 3064 aa, Homo sapiens
  Payload ID: 10752
  Gene Symbol: MYO15B
  Gene Name: myosin XVB
  ENSP ID: ENSP00000488624
MGRNQRKAPQRLERPGRPASGEQESGSASADGAPSRERRSDRGQADRAKPAAEPATAGGQGTPGGRRKPTAEGNGGCRRPGAGLSPKAQERQSNAQRQGRGPRGGRGGRLEEGSLSGGEELGGRRRRKRKDKGPSARRGRRTPRSLNGDTSGGDGGSSCPDSETREAQESGSQRGTARELRPTPEPTDMGSEGTKTGPESALEPSSDGLDSDWPHADTRGREGSSGTGPLGASEHSGGDSDSSPLGTGPGRGSRAAMASRTFEDSSRAPRDTGPAKDASDNRAQRGAEPETMQASTARAPRHQVGKAVGQVPAAAGEGEAGAAAGAGPEDPAPLAALLVVRRLLARPPPGAASQAVGPRRAGLKERLLSVARALGLLRWLRRRLRLRRRPPEGEGQGTGPRASEGWGRRKPDEGRGHGRGSKGRGRGKADEGRGHERGDEGRGRGKADEGRGHERGYEGRGCGKADEGRGHERGDEGRDHQRGYEGWGREPGLRHRLALRLAGLAGLGGMPRASPGGRSPQVPTSPVPGDPFDQEDETPDPKFAVVFPRIHRAGRASSSRSSEEASADAPTGEGRGWPRAGVGGHSEGCRTSGEGVSGLRRGSLLAPTAPDGPSLDESGSSSEAELETLNDEPPVRWAQGSGPHEGPRLGAAVLLPRLSLETRLQQEGDPGLRGSLRELWEPEDEDEAVLERDLELSLRPGLEAPPFPGAKGRSLGDGLEDMEDLARLRHIFAIVASAYDLAQNTGQDPCILLCGHSGSGKTEAAKKIMQFLSSLEQDQTGNRECQVEDMLPILSSFGHAKTILNANASRFGQVFCLYLQQGVIVGASVSHYLLETSRVVFQAQAERSFHVFYKLLAGLDSIERERLSLQGPETYYYLNQGQACRLQGKEDAQDFEGLLKALQGLGLCPEELNAVWAVLAAILQLGNICFSSSERESQEVAAVSSWAEIHTAARLLRVPPECLEGAVTRRVTETPYGQVSRSLPVESAFDARDALAKALYSRLFHRLLRRTNARLAPPGEGGSIGTVTVVDAYGFEALRVNGLEQLCNNLASERLQLFSSQMLLAQEEPPRESCLDLLVDQPHSLLSILDAQTWLSQTEFGSCCPGWSAMVRSRLTATSTSQATDHTFLQKSHYHHGDHPSYAKPRLPLPVFTVRHYAGTVTYQVHKFLNRNRDQLDPAVVEMLGQSQLQLVGSLFQEAEPQSRGGRGRPTLASRFQQALEDLIARLGRSHVYFIQCLTPNPGKLPGLFDVGHVTEQLHQAAILEAVGTRSANFPVRVPFEAFLASFQALGSEGQEDLSDREKCGAVLSQVLGAESPLYHLGATKVLLQEQGWQRLEELRDQQRSQALVDLHRSFHTCISRQRVLPRMQARMRGFQARSAGVGARAEVGGPVFTHSSNSCWLTVCLIYPWARCWKRYLRRRAALGQLNTILLVAQPLLQRRQRLQLGRWQGWHSSERALERVPSMELGRLEIPAELAVMLKTAESHRDALAGSITECLPPEVPARPSLTLPADIDLFPFSSFVAIGFQEPSLPRPGQPLAKPLTQLDGDNPQRALDINKVMLRLLGDGSLESWQRQIMGAYLVRQGQCRPGLRNELFSQLVAQLWQNPDEQQSQRGWALMAVLLSAFPPLPVLQKPLLKFVSDQAPRGMAALCQHKLLGALEQSQLASGATRAHPPTQLEWLAGWRRGRMALDVFTFSEECYSAEVESWTTGEQLAGWILQSRDAWQDLAGCDFVLDLISQTEDLGDPARPRSYPITPLGSAEAIPLAPGIQAPSLPPGPPPGPAPTLPSRDHTGEVQRSGSLDGFLDQIFQPVISSGLSDLEQSWALSSRMKGGGAIGPTQQGYPMVYPGMIQMPAYQPGMVPAPMPMMPAMGTVPAMPAMVVPPQPPLPSLDAGQLAVQQQNFIQQQALILAQQMTAQAMSLSLEQQMQQRQQQARASEAASQASPSAVTSKPRKPPTPPEKPQRDLGSEGGCLRETSEEAEDRPYQPKSFQQKRNYFQRMGQPQITVRTMKPPAKVHIPQGEAQEEEEEEEEEEEQEEQEVETRAVPSPPPPPIVKKPLKQGGAKAPKEAEAEPAKETAAKGHGQGPAQGRGTVVRSSDSKPKRPQPSREIGNIIRMYQSRPGPVPVPVQPSRPPKAFLRKIDPKDEALAKLGINGAHSSPPMLSPSPGKGPPPAVAPRPKAPLQLGPSSSIKEKQGPLLDLFGQKLPIAHTPPPPPAPPLPLPEDPGTLSAERRCLTQPVEDQGVSTQLLAPSGSVCFSYTGTPWKLFLRKEVFYPRENFSHPYYLRLLCEQILRDTFSESCIRISQNERRKMKDLLGGLEVDLDSLTTTEDSVKKRIVVAARDNWANYFSRFFPVSGESGSDVQLLAVSHRALAHDPGLEVGAGGKVTSVHARSLRSFAEVLGVECRGGSTLELSLKSEQLVLHTARARAIEALVELFLNELKKDSGYVIALRSYITDNCSLLSFHRGDLIKLLPVATLEPGWQFGSAGGRSGLFPADIVQPAAAPDFSFSKEQRSGWHKGQLSNGEPGLARWDRASERPAHPWSQAHSDDSEATSLSSVAYAFLPDSHSYTMQEFARRYFRRSQALLGQTDGGAAGKDTDSLVQYTKAPIQESLLSLSDDVSKLAVASFLALMRFMGDQSKPRGKDEMDLLYELLKLCQQEKLRDEIYCQVIKQVTGHPRPEHCTRGWSFLSLLTGFFPPSTRLMPYLTKFLQDSGPSQELARSSQEHLQRTVKYGGRRRMPPPGEMKAFLVAAEVQEELCRQMGITEPQEVQEFALFLIKEKSQLVRPLQPAEYLNSVVVDQDVSLHSRRLHWETPLHFDNSTYISTHYSQVLWDYLQGKLPVSAKADAQLARLAALQHLSKANRNTPSGQDLLAYVPKQLQRQVNTASIKNLMGQELRRLEGHSPQEAQISFIADLGDQAEQVPGPQQSDFLPAPSPPAEAMSQLPLFGYTVYGVLRVSMQALSGPTLLGLNRQHLILMDPSSQSLYCRIALKSLQRLHLLSPLEEKGPPGLEVNYGSADNPQTIWFELPQAQELLYTTVFLIDSSASCTEWPSIN

SEQ ID NO: 54478 - protein, 101 aa, Homo sapiens
  Payload ID: 10752
  Gene Symbol: MYO15B
  Gene Name: myosin XVB
  ENSP ID: ENSP00000488771
  MOD_RES (1)..(1): Any amino acid
XFVSDQAPRGMAALCQHKLLGALEQSQLASGATRAHPPTQLEWLAGWRRGRMALDVFTFSEECYSAEVESWTTGEQLAGWILQSRSEKKCPCWSPCGSGGP

SEQ ID NO: 54479 - protein, 760 aa, Homo sapiens; identical to SEQ ID NO: 54467
  Payload ID: 10752
  Gene Symbol: MYO15B
  Gene Name: myosin XVB
  ENSP ID: ENSP00000488884

SEQ ID NO: 54480 - protein, 940 aa, Homo sapiens; identical to SEQ ID NO: 54119
  Payload ID: 10753
  Gene Symbol: MYO16
  Gene Name: myosin XVI
  Uniprot ID: Q9Y6X6
  ENSP ID: ENSP00000251041

SEQ ID NO: 54481 - protein, 1858 aa, Homo sapiens; identical to SEQ ID NO: 54117
  Payload ID: 10753
  Gene Symbol: MYO16
  Gene Name: myosin XVI
  Uniprot ID: Q9Y6X6
  ENSP ID: ENSP00000349145

SEQ ID NO: 54482 - protein, 1858 aa, Homo sapiens; identical to SEQ ID NO: 54117
  Payload ID: 10753
  Gene Symbol: MYO16
  Gene Name: myosin XVI
  Uniprot ID: Q9Y6X6
  ENSP ID: ENSP00000350160

SEQ ID NO: 54483 - protein, 1880 aa, Homo sapiens; identical to SEQ ID NO: 54118
  Payload ID: 10753
  Gene Symbol: MYO16
  Gene Name: myosin XVI
  ENSP ID: ENSP00000401633

SEQ ID NO: 54484 - protein, 2039 aa, Homo sapiens
  Payload ID: 10754
  Gene Symbol: MYO18A
  Gene Name: myosin XVIIIA
  Uniprot ID: Q92614
  ENSP ID: ENSP00000434228
MFNLMKKDKDKDGGRKEKKEKKEKKERMSAAELRSLEEMSLRRGFFNLNRSSKRESKTRLEISNPIPIKVASGSDLHLTDIDSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELVTKKFPVDLRLPPVVPLPPPTLRELELQRRPTGDFGFSLRRTTMLDRGPEGQACRRVVHFAEPGAGTKDLALGLVPGDRLVEINGHNVESKSRDEIVEMIRQSGDSVRLKVQPIPELSELSRSWLRSGEGPRREPSDAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54485 - protein, 27 aa, Homo sapiens
  Payload ID: 10754
  Gene Symbol: MYO18A
  Gene Name: myosin XVIIIA
  ENSP ID: ENSP00000434817
  MOD_RES (1)..(1): Any amino acid
XVSLLWAAPGQAMRKVCCYEDSMRRPV

SEQ ID NO: 54486 - protein, 2002 aa, Homo sapiens
  Payload ID: 10754
  Gene Symbol: MYO18A
  Gene Name: myosin XVIIIA
  Uniprot ID: Q92614
  ENSP ID: ENSP00000435932
MFNLMKKDKDKDGGRKEKKEKKEKKERMSAAELRSLEEMSLRRGFFNLNRSSKRESKTRLEISNPIPIKVASGSDLHLTDIDSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELVTKKFPVDLRLPPVVPLPPPTLRELELQRRPTGDFGFSLRRTTMLDRGPEGQACRRVVHFAEPGAGTKDLALGLVPGDRLVEINGHNVESKSRDEIVEMIRQSGDSVRLKVQPIPELSELSRSWLRSGEGPRREPSDAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54487 - protein, 197 aa, Homo sapiens
  Payload ID: 10754
  Gene Symbol: MYO18A
  Gene Name: myosin XVIIIA
  ENSP ID: ENSP00000436660
  MOD_RES (1)..(1): Any amino acid
XFELLTEPEQHQSGVSLLWAAPGQAMRLDSEAASHAHSQAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQD

SEQ ID NO: 54488 - protein, 2054 aa, Homo sapiens
  Payload ID: 10754
  Gene Symbol: MYO18A
  Gene Name: myosin XVIIIA
  Uniprot ID: Q92614
  ENSP ID: ENSP00000437073
MFNLMKKDKDKDGGRKEKKEKKEKKERMSAAELRSLEEMSLRRGFFNLNRSSKRESKTRLEISNPIPIKVASGSDLHLTDIDSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELVTKKFPVDLRLPPVVPLPPPTLRELELQRRPTGDFGFSLRRTTMLDRGPEGQACRRVVHFAEPGAGTKDLALGLVPGDRLVEINGHNVESKSRDEIVEMIRQSGDSVRLKVQPIPELSELSRSWLRSGEGPRREPSDAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSLQDMVTKYQKRKNKLEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54489 - protein, 93 aa, Homo sapiens
  Payload ID: 10754
  Gene Symbol: MYO18A
  Gene Name: myosin XVIIIA
  ENSP ID: ENSP00000465542
  MOD_RES (1)..(1): Any amino acid
XPRSSPWTLTKLARWPQPPFRQCFWRSCVWLGAQPVKPHSTSSTTCWPVGMAPSGQSSTSTTWQRTMCLGLCHWPSLRKSRRQLSSLVSCRRP

SEQ ID NO: 54490 - protein, 2038 aa, Homo sapiens
  Payload ID: 10754
  Gene Symbol: MYO18A
  Gene Name: myosin XVIIIA
  ENSP ID: ENSP00000486682
MFNLMKKDKDKDGGRKEKKEKKEKKERMSAAELRSLEEMSLRRGFFNLNRSSKRESKTRLEISNPIPIKVASGSDLHLTDIDSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELVTKKFPVDLRLPPVVPLPPPTLRELELQRRPTGDFGFSLRRTTMLDRGPEGQACRRVVHFAEPGAGTKDLALGLVPGDRLVEINGHNVESKSRDEIVEMIRQSGDSVRLKVQPIPELSELSRSWLRSGEGPRREPSDAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKPAVAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54491 - protein, 2567 aa, Homo sapiens
  Payload ID: 10755
  Gene Symbol: MYO18B
  Gene Name: myosin XVIIIB
  ENSP ID: ENSP00000334563
MAISSRLALWEQKIREEDKSPPPSSPPPLFSVIPGGFIKQLVRGTEKEAKEARQRKQLAVASPEREIPEISISQPNSKSSSGTRSGSQQISQDDQSSSPGSSDILGKESEGSRSPDPEQMTSINGEKAQELGSSATPTKKTVPFKRGVRRGDVLLMVAKLDPDSAKPEKTHPHDAPPCKTSPPATDTGKEKKGETSRTPCGSQASTEILAPKAEKTRTGGLGDPGQGTVALKKGEEGQSIVGKGLGTPKTTELKEAEPQGKDRQGTRPQAQGPGEGVRPGKAEKEGAEPTNTVEKGNVSKDVGSEGKHVRPQIPGRKWGGFLGRRSKWDGPQNKKDKEGVLLSKAEKTGEPQTQMEKTSQVQGELGDDLRMGEKAGELRSTTGKAGESWDKKEKMGQPQGKSGNAGEARSQTEKGCEAPKEVSTMVESPAAPGKGGWPGSRGQEAEEPCSRAGDGAGALETELEGPSQPALEKDAERPRIRKENQDGPAPQEEGKGGQSRDSDQAPEDRWYEAEKVWLAQKDGFTLATVLKPDEGTADLPAGRVRLWIDADKTITEVDEEHVHRANPPELDQVEDLASLISVNESSVLNTLLQRYKAQLLHTCTGPDLIVLQPRGPSVPSAGKVPKGRRDGLPAHIGSMAQRAYWALLNQRRDQSIVALGWSGAGKTTCCEQVLEHLVGMAGSVDGRVSVEKIRATFTVLRAFGSVSMAHSRSATRFSMVMSLDFNATGRITAAQLQTMLLEKSRVARQPEGESNFLVFSQMLAGLDLDLRTELNLHQMADSSSFGMGVWSKPEDKQKAAAAFAQLQGAMEMLGISESEQRAVWRVLAAIYHLGAAGACKVGRKQFMRFEWANYAAEALGCEYEELNTATFKHHLRQIIQQMTFGPSRWGLEDEETSSGLKMTGVDCVEGMASGLYQELFAAVVSLINRSFSSHHLSMASIMVVDSPGFQNPRHQGKDRAATFEELCHNYAHERLQLLFYQRTFVSTLQRYQEEGVPVQFDLPDPSPGTTVAVVDQNPSQVRLPAGGGAQDARGLFWVLDEEVHVEGSSDSVVLERLCAAFEKKGAGTEGSSALRTCEQPLQCEIFHQLGWDPVRYDLTGWLHRAKPNLSALDAPQVLHQSKREELRSLFQARAKLPPVCRAVAGLEGTSQQALQRSRMVRRTFASSLAAVRRKAPCSQIKLQMDALTSMIKRSRLHFIHCLVPNPVVESRSGQESPPPPQPGRDKPGAGGPLALDIPALRVQLAGFHILEALRLHRTGYADHMGLTRFRRQFQVLDAPLLKKLMSTSEGIDERKAVEELLETLDLEKKAVAVGHSQVFLKAGVISRLEKQREKLVSQSIVLFQAACKGFLSRQEFKKLKIRRLAAQCIQKNVAVFLAVKDWPWWQLLGSLQPLLSATIGTEQLRAKEEELTTLRRKLEKSEKLRNELRQNTDLLESKIADLTSDLADERFKGDVACQVLESERAERLQAFREVQELKSKHEQVQKKLGDVNKQLEEAQQKIQLNDLERNPTGGADEWQMRFDCAQMENEFLRKRLQQCEERLDSELTARKELEQKLGELQSAYDGAKKMAHQLKRKCHHLTCDLEDTCVLLENQQSRNHELEKKQKKFDLQLAQALGESVFEKGLREKVTQENTSVRWELGQLQQQLKQKEQEASQLKQQVEMLQDHKRELLGSPSLGENCVAGLKERLWKLESSALEQQKIQSQQENTIKQLEQLRQRFELEIERMKQMHQKDREDQEEELEDVRQSCQKRLHQLEMQLEQEYEEKQMVLHEKQDLEGLIGTLCDQIGHRDFDVEKRLRRDLRRTHALLSDVQLLLGTMEDGKTSVSKEELEKVHSQLEQSEAKCEEALKTQKVLTADLESMHSELENMTRNKSLVDEQLYRLQFEKADLLKRIDEDQDDLNELMQKHKDLIAQSAADIGQIQELQLQLEEAKKEKHKLQEQLQVAQMRIEYLEQSTVDRAIVSRQEAVICDLENKTEFQKVQIKRFEVLVIRLRDSLIKMGEELSQAATSESQQRESSQYYQRRLEELKADMEELVQREAEASRRCMELEKYVEELAAVRQTLQTDLETSIRRIADLQAALEEVASSDSDTESVQTAVDCGSSGRKEMDNVSILSSQPEGSLQSWLSCTLSLATDTMRTPSRQSATSSRILSPRINEEAGDTERTQSALALSRARSTNVHSKTSGDKPVSPHFVRRQKYCHFGDGEVLAVQRKSTERLEPASSPLASRSTNTSPLSREKLPSPSAALSEFVEGLRRKRAQRGQGSTLGLEDWPTLPIYQTTGASTLRRGRAGSDEGNLSLRVGAKSPLEIEGAAGGLLRSTSLKCISSDGVGGTTLLPEKSKTQFSSCESLLESRPSMGRKLSSPTTPRDMLLSPTLRPRRRCLESSVDDAGCPDLGKEPLVFQNRQFAHLMEEPLGSDPFSWKLPSLDYERKTKVDFDDFLPAIRKPQTPTSLAGSAKGGQDGSQRSSIHFETEEANRSFLSGIKTILKKSPEPKEDPAHLSDSSSSSGSIVSFKSADSIKSRPGIPRLAGDGGERTSPERREPGTGRKDDDVASIMKKYLQK

SEQ ID NO: 54492 - protein, 2568 aa, Homo sapiens
  Payload ID: 10755
  Gene Symbol: MYO18B
  Gene Name: myosin XVIIIB
  ENSP ID: ENSP00000386096
MAISSRLALWEQKIREEDKSPPPSSPPPLFSVIPGGFIKQLVRGTEKEAKEARQRKQLAVASPEREIPEISISQPNSKSSSGTRSGSQQISQDDQSSSPGSSDILGKESEGSRSPDPEQMTSINGEKAQELGSSATPTKKTVPFKRGVRRGDVLLMVAKLDPDSAKPEKTHPHDAPPCKTSPPATDTGKEKKGETSRTPCGSQASTEILAPKAEKTRTGGLGDPGQGTVALKKGEEGQSIVGKGLGTPKTTELKEAEPQGKDRQGTRPQAQGPGEGVRPGKAEKEGAEPTNTVEKGNVSKDVGSEGKHVRPQIPGRKWGGFLGRRSKWDGPQNKKDKEGVLLSKAEKTGEPQTQMEKTSQVQGELGDDLRMGEKAGELRSTTGKAGESWDKKEKMGQPQGKSGNAGEARSQTEKGCEAPKEVSTMVESPAAPGKGGWPGSRGQEAEEPCSRAGDGAGALETELEGPSQPALEKDAERPRIRKENQDGPAPQEEGKGGQSRDSDQAPEDRWYEAEKVWLAQKDGFTLATVLKPDEGTADLPAGRVRLWIDADKTITEVDEEHVHRANPPELDQVEDLASLISVNESSVLNTLLQRYKAQLLHTCTGPDLIVLQPRGPSVPSAGKVPKGRRDGLPAHIGSMAQRAYWALLNQRRDQSIVALGWSGAGKTTCCEQVLEHLVGMAGSVDGRVSVEKIRATFTVLRAFGSVSMAHSRSATRFSMVMSLDFNATGRITAAQLQTMLLEKSRVARQPEGESNFLVFSQMLAGLDLDLRTELNLHQMADSSSFGMGVWSKPEDKQKAAAAFAQLQGAMEMLGISESEQRAVWRVLAAIYHLGAAGACKVGRKQFMRFEWANYAAEALGCEYEELNTATFKHHLRQIIQQMTFGPSRWGLEDEETSSGLKMTGVDCVEGMASGLYQELFAAVVSLINRSFSSHHLSMASIMVVDSPGFQNPRHQGKDRAATFEELCHNYAHERLQLLFYQRTFVSTLQRYQEEGVPVQFDLPDPSPGTTVAVVDQNPSQQVRLPAGGGAQDARGLFWVLDEEVHVEGSSDSVVLERLCAAFEKKGAGTEGSSALRTCEQPLQCEIFHQLGWDPVRYDLTGWLHRAKPNLSALDAPQVLHQSKREELRSLFQARAKLPPVCRAVAGLEGTSQQALQRSRMVRRTFASSLAAVRRKAPCSQIKLQMDALTSMIKRSRLHFIHCLVPNPVVESRSGQESPPPPQPGRDKPGAGGPLALDIPALRVQLAGFHILEALRLHRTGYADHMGLTRFRRQFQVLDAPLLKKLMSTSEGIDERKAVEELLETLDLEKKAVAVGHSQVFLKAGVISRLEKQREKLVSQSIVLFQAACKGFLSRQEFKKLKIRRLAAQCIQKNVAVFLAVKDWPWWQLLGSLQPLLSATIGTEQLRAKEEELTTLRRKLEKSEKLRNELRQNTDLLESKIADLTSDLADERFKGDVACQVLESERAERLQAFREVQELKSKHEQVQKKLGDVNKQLEEAQQKIQLNDLERNPTGGADEWQMRFDCAQMENEFLRKRLQQCEERLDSELTARKELEQKLGELQSAYDGAKKMAHQLKRKCHHLTCDLEDTCVLLENQQSRNHELEKKQKKFDLQLAQALGESVFEKGLREKVTQENTSVRWELGQLQQQLKQKEQEASQLKQQVEMLQDHKRELLGSPSLGENCVAGLKERLWKLESSALEQQKIQSQQENTIKQLEQLRQRFELEIERMKQMHQKDREDQEEELEDVRQSCQKRLHQLEMQLEQEYEEKQMVLHEKQDLEGLIGTLCDQIGHRDFDVEKRLRRDLRRTHALLSDVQLLLGTMEDGKTSVSKEELEKVHSQLEQSEAKCEEALKTQKVLTADLESMHSELENMTRNKSLVDEQLYRLQFEKADLLKRIDEDQDDLNELMQKHKDLIAQSAADIGQIQELQLQLEEAKKEKHKLQEQLQVAQMRIEYLEQSTVDRAIVSRQEAVICDLENKTEFQKVQIKRFEVLVIRLRDSLIKMGEELSQAATSESQQRESSQYYQRRLEELKADMEELVQREAEASRRCMELEKYVEELAAVRQTLQTDLETSIRRIADLQAALEEVASSDSDTESVQTAVDCGSSGRKEMDNVSILSSQPEGSLQSWLSCTLSLATDTMRTPSRQSATSSRILSPRINEEAGDTERTQSALALSRARSTNVHSKTSGDKPVSPHFVRRQKYCHFGDGEVLAVQRKSTERLEPASSPLASRSTNTSPLSREKLPSPSAALSEFVEGLRRKRAQRGQGSTLGLEDWPTLPIYQTTGASTLRRGRAGSDEGNLSLRVGAKSPLEIEGAAGGLLRSTSLKCISSDGVGGTTLLPEKSKTQFSSCESLLESRPSMGRKLSSPTTPRDMLLSPTLRPRRRCLESSVDDAGCPDLGKEPLVFQNRQFAHLMEEPLGSDPFSWKLPSLDYERKTKVDFDDFLPAIRKPQTPTSLAGSAKGGQDGSQRSSIHFETEEANRSFLSGIKTILKKSPEPKEDPAHLSDSSSSSGSIVSFKSADSIKSRPGIPRLAGDGGERTSPERREPGTGRKDDDVASIMKKYLQK

SEQ ID NO: 54493 - protein, 798 aa, Homo sapiens
  Payload ID: 10755
  Gene Symbol: MYO18B
  Gene Name: myosin XVIIIB
  ENSP ID: ENSP00000437587
MAISSRLALWEQKIREEDKSPPPSSPPPLFSVIPGGFIKQLVRGTEKEAKEARQRKQLAVASPEREIPEISISQPNSKSSSGTRSGSQQISQDDQSSSPGSSDILGKESEGSRSPDPEQMTSINGEKAQELGSSATPTKKTVPFKRGVRRGDVLLMVAKLDPDSAKPEKTHPHDAPPCKTSPPATDTGKEKKGETSRTPCGSQASTEILAPKAEKTRTGGLGDPGQGTVALKKGEEGQSIVGKGLGTPKTTELKEAEPQGKDRQGTRPQAQGPGEGVRPGKAEKEGAEPTNTVEKGNVSKDVGSEGKHVRPQIPGRKWGGFLGRRSKWDGPQNKKDKEGVLLSKAEKTGEPQTQMEKTSQVQGELGDDLRMGEKAGELRSTTGKAGESWDKKEKMGQPQGKSGNAGEARSQTEKGCEAPKEVSTMVESPAAPGKGGWPGSRGQEAEEPCSRAGDGAGALETELEGPSQPALEKDAERPRIRKENQDGPAPQEEGKGGQSRDSDQAPEDRWYEAEKVWLAQKDGFTLATVLKPDEGTADLPAGRVRLWIDADKTITEVDEEHVHRANPPELDQVEDLASLISVNESSVLNTLLQRYKAQLLHTCTGPDLIVLQPRGPSVPSAGKVPKGRRDGLPAHIGSMAQRAYWALLNQRRDQSIVALGWSGAGKTTCCEQVLEHLVGMAGSVDGRVSVEKIRATFTVLRAFGSVSMAHSRSATRFSMVMSLDFNATGRITAAQLQTMLLEKSRVARQPEGESNFLVFSQMLAGLDLDLRTELNLHQMADSSSFGMGVWSKWVGSSS

SEQ ID NO: 54494 - protein, 2567 aa, Homo sapiens; identical to SEQ ID NO: 54491
  Payload ID: 10755
  Gene Symbol: MYO18B
  Gene Name: myosin XVIIIB
  ENSP ID: ENSP00000441229

SEQ ID NO: 54495 - protein, 209 aa, Homo sapiens
  Payload ID: 10755
  Gene Symbol: MYO18B
  Gene Name: myosin XVIIIB
  Uniprot ID: Q8IUG5
  ENSP ID: ENSP00000441301
PSMGRKLSSPTTPRDMLLSPTLRPRRRCLESSVDDAGCPDLGKEPLVFQNRQFAHLMEEPLGSDPFSWKLPSLDYERKTKVDFDDFLPAIRKPQTPTSLAGSAKGGQDGSQRSSIHFETEEANRSFLSGIKTILKKSPEPKEDPAHLSDSSSSSGSIVSFKSADSIKSRPGIPRLAGDGGERTSPERREPGTGRKDDDVASIMKKYLQK

SEQ ID NO: 54496 - protein, 517 aa, Homo sapiens
  Payload ID: 10755
  Gene Symbol: MYO18B
  Gene Name: myosin XVIIIB
  ENSP ID: ENSP00000444262
  MOD_RES (1)..(1): Any amino acid
XELVQREAEASRRCMELEKYVEELAAVRQTLQTDLETSIRRIADLQAALEEVASSDSDTERDNVSILSSQPEGSLQSWLSCTLSLATDTMRTPSRQSATSSRILSPRINEEAGDTERTQSALALSRARSTNVHSKTSGDKPVSPHFVRRQKYCHFGDGEVLAVQRKSTERLEPASSPLASRSTNTSPLSREKLPSPSAALSEFVEGLRRKRAQRGQGSTLGLEDWPTLPIYQTTGASTLRRGRAGSDEGNLSLRVGAKSPLEIEGAAGGLLRSTSLKCISSDGVGGTTLLPEKSKTQFSSCESLLESRPSMGRKLSSPTTPRDMLLSPTLRPRRRCLESSVDDAGCPDLGKEPLVFQNRQFAHLMEEPLGSDPFSWKLPSLDYERKTKVDFDDFLPAIRKPQTPTSLAGSAKGGQDGSQRSSIHFETEEANRSFLSGIKTILKKSPEPKEDPAHLSDSSSSSGSIVSFKSADSIKSRPGIPRLAGDGGERTSPERREPGTGRKDDDVASIMKKYLQK

SEQ ID NO: 54497 - protein, 1939 aa, Homo sapiens
  Payload ID: 10756
  Gene Symbol: MYH1
  Gene Name: myosin, heavy chain 1, skeletal muscle, adult
  Uniprot ID: P12882
  ENSP ID: ENSP00000226207
MSSDSEMAIFGEAAPFLRKSERERIEAQNKPFDAKTSVFVVDPKESFVKATVQSREGGKVTAKTEAGATVTVKDDQVFPMNPPKYDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEVTSGKMQGTLEDQIISANPLLEAFGNAKTVRNDNSSRFGKFIRIHFGTTGKLASADIETYLLEKSRVTFQLKAERSYHIFYQIMSNKKPDLIEMLLITTNPYDYAFVSQGEITVPSIDDQEELMATDSAIEILGFTSDERVSIYKLTGAVMHYGNMKFKQKQREEQAEPDGTEVADKAAYLQNLNSADLLKALCYPRVKVGNEYVTKGQTVQQVYNAVGALAKAVYDKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYEQHLGKSNNFQKPKPAKGKPEAHFSLIHYAGTVDYNIAGWLDKNKDPLNETVVGLYQKSAMKTLALLFVGATGAEAEAGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDIDHTQYKFGHTKVFFKAGLLGLLEEMRDEKLAQLITRTQAMCRGFLARVEYQKMVERRESIFCIQYNVRAFMNVKHWPWMKLYFKIKPLLKSAETEKEMANMKEEFEKTKEELAKTEAKRKELEEKMVTLMQEKNDLQLQVQAEADSLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKIRMDLERAKRKLEGDLKLAQESTMDIENDKQQLDEKLKKKEFEMSGLQSKIEDEQALGMQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNMETVSKAKGNLEKMCRALEDQLSEIKTKEEEQQRLINDLTAQRARLQTESGEYSRQLDEKDTLVSQLSRGKQAFTQQIEELKRQLEEEIKAKSALAHALQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMIDVERTNAACAALDKKQRNFDKILAEWKQKCEETHAELEASQKESRSLSTELFKIKNAYEESLDQLETLKRENKNLQQEISDLTEQIAEGGKRIHELEKIKKQVEQEKSELQAALEEAEASLEHEEGKILRIQLELNQVKSEVDRKIAEKDEEIDQMKRNHIRIVESMQSTLDAEIRSRNDAIRLKKKMEGDLNEMEIQLNHANRMAAEALRNYRNTQAILKDTQLHLDDALRSQEDLKEQLAMVERRANLLQAEIEELRATLEQTERSRKIAEQELLDASERVQLLHTQNTSLINTKKKLETDISQIQGEMEDIIQEARNAEEKAKKAITDAAMMAEELKKEQDTSAHLERMKKNLEQTVKDLQHRLDEAEQLALKGGKKQIQKLEARVRELEGEVESEQKRNVEAVKGLRKHERKVKELTYQTEEDRKNILRLQDLVDKLQAKVKSYKRQAEEAEEQSNVNLSKFRRIQHELEEAEERADIAESQVNKLRVKSREVHTKIISEE

SEQ ID NO: 54498 - protein, 1976 aa, Homo sapiens
  Payload ID: 10757
  Gene Symbol: MYH10
  Gene Name: myosin, heavy chain 10, non-muscle
  Uniprot ID: P35580
  ENSP ID: ENSP00000269243
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 54499 - protein, 2007 aa, Homo sapiens
  Payload ID: 10757
  Gene Symbol: MYH10
  Gene Name: myosin, heavy chain 10, non-muscle
  Uniprot ID: P35580
  ENSP ID: ENSP00000353590
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPQESPKPVKHQGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDEIQNIQRASFYDSVSGLHEPPVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 54500 - protein, 1985 aa, Homo sapiens
  Payload ID: 10757
  Gene Symbol: MYH10
  Gene Name: myosin, heavy chain 10, non-muscle
  Uniprot ID: P35580
  ENSP ID: ENSP00000369315
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPESPKPVKHQGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 54501 - protein, 187 aa, Homo sapiens
  Payload ID: 10757
  Gene Symbol: MYH10
  Gene Name: myosin, heavy chain 10, non-muscle
  ENSP ID: ENSP00000408220
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTEN

SEQ ID NO: 54502 - protein, 1972 aa, Homo sapiens
  Payload ID: 10758
  Gene Symbol: MYH11
  Gene Name: myosin, heavy chain 11, smooth muscle
  Uniprot ID: P35749
  ENSP ID: ENSP00000300036
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRRGNETSFVPSRRSGGRRVIENADGSEEETDTRDADFNGTKASE

SEQ ID NO: 54503 - protein, 1979 aa, Homo sapiens
  Payload ID: 10758
  Gene Symbol: MYH11
  Gene Name: myosin, heavy chain 11, smooth muscle
  Uniprot ID: P35749
  ENSP ID: ENSP00000379616
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITQGPSFAYGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRRGNETSFVPSRRSGGRRVIENADGSEEETDTRDADFNGTKASE

SEQ ID NO: 54504 - protein, 1945 aa, Homo sapiens
  Payload ID: 10758
  Gene Symbol: MYH11
  Gene Name: myosin, heavy chain 11, smooth muscle
  Uniprot ID: P35749
  ENSP ID: ENSP00000407821
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITQGPSFAYGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPPQETSQ

SEQ ID NO: 54505 - protein, 1938 aa, Homo sapiens
  Payload ID: 10758
  Gene Symbol: MYH11
  Gene Name: myosin, heavy chain 11, smooth muscle
  Uniprot ID: P35749
  ENSP ID: ENSP00000458731
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPPQETSQ

SEQ ID NO: 54506 - protein, 1945 aa, Homo sapiens; identical to SEQ ID NO: 54504
  Payload ID: 10758
  Gene Symbol: MYH11
  Gene Name: myosin, heavy chain 11, smooth muscle
  Uniprot ID: P35749
  ENSP ID: ENSP00000478092

SEQ ID NO: 54507 - protein, 1979 aa, Homo sapiens; identical to SEQ ID NO: 54503
  Payload ID: 10758
  Gene Symbol: MYH11
  Gene Name: myosin, heavy chain 11, smooth muscle
  Uniprot ID: P35749
  ENSP ID: ENSP00000478109

SEQ ID NO: 54508 - protein, 1938 aa, Homo sapiens; identical to SEQ ID NO: 54505
  Payload ID: 10758
  Gene Symbol: MYH11
  Gene Name: myosin, heavy chain 11, smooth muscle
  Uniprot ID: P35749
  ENSP ID: ENSP00000478816

SEQ ID NO: 54509 - protein, 2029 aa, Homo sapiens
  Payload ID: 10758
  Gene Symbol: MYH11
  Gene Name: myosin, heavy chain 11, smooth muscle
  ENSP ID: ENSP00000479371
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITEGPSFWRGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPHRKLRSDAPGEETRPLSFLLEGLEDVELLKMQMVLRRKRTLETQTSMEPRPVNKQLSTVLHHGKKTKNQNKQTKKTQQQPRTKQNPADCT

SEQ ID NO: 54510 - protein, 2029 aa, Homo sapiens; identical to SEQ ID NO: 54509
  Payload ID: 10758
  Gene Symbol: MYH11
  Gene Name: myosin, heavy chain 11, smooth muscle
  ENSP ID: ENSP00000484924

SEQ ID NO: 54511 - protein, 1972 aa, Homo sapiens; identical to SEQ ID NO: 54502
  Payload ID: 10758
  Gene Symbol: MYH11
  Gene Name: myosin, heavy chain 11, smooth muscle
  Uniprot ID: P35749
  ENSP ID: ENSP00000488461

SEQ ID NO: 54512 - protein, 1938 aa, Homo sapiens
  Payload ID: 10759
  Gene Symbol: MYH13
  Gene Name: myosin, heavy chain 13, skeletal muscle
  Uniprot ID: Q9UKX3
  ENSP ID: ENSP00000252172
MSSDAEMAIFGEAAPYLRKPEKERIEAQNRPFDSKKACFVADNKEMYVKGMIQTRENDKVIVKTLDDRMLTLNNDQVFPMNPPKFDKIEDMAMMTHLHEPAVLYNLKERYAAWMIYTYSGLFCVTVNPYKWLPVYKPEVVAAYRGKKRQEAPPHIFSISDNAYQFMLTDRDNQSILITGESGAGKTVNTKRVIQYFATIAVTGDKKKETQPGKMQGTLEDQIIQANPLLEAFGNAKTVRNDNSSRFGKFIRIHFGATGKLASADIETYLLEKSRVTFQLSSERSYHIFYQIMSNKKPELIDLLLISTNPFDFPFVSQGEVTVASIDDSEELLATDNAIDILGFSSEEKVGIYKLTGAVMHYGNMKFKQKQREEQAEPDGTEVADKAGYLMGLNSAEMLKGLCCPRVKVGNEYVTKGQNVQQVTNSVGALAKAVYEKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYDQHLGKSNNFQKPKPAKGKAEAHFSLVHYAGTVDYNIAGWLDKNKDPLNETVVGLYQKSSLKLLSFLFSNYAGAETGDSGGSKKGGKKKGSSFQTVSAVFRENLNKLMTNLRSTHPHFVRCLIPNETKTPGVMDHYLVMHQLRCNGVLEGIRICRKGFPSRILYADFKQRYRILNASAIPEGQFIDSKNASEKLLNSIDVDREQFRFGNTKVFFKAGLLGLLEEMRDEKLVTLMTSTQAVCRGYLMRVEFKKMMERRDSIFCIQYNIRSFMNVKHWPWMNLFFKIKPLLKSAEAEKEMATMKEDFERTKEELARSEARRKELEEKMVSLLQEKNDLQLQVQSETENLMDAEERCEGLIKSKILLEAKVKELTERLEEEEEMNSELVAKKRNLEDKCSSLKRDIDDLELTLTKVEKEKHATENKVKNLSEEMTALEENISKLTKEKKSLQEAHQQTLDDLQVEEDKVNGLIKINAKLEQQTDDLEGSLEQEKKLRADLERAKRKLEGDLKMSQESIMDLENDKQQIEEKLKKKEFELSQLQAKIDDEQVHSLQFQKKIKELQARIEELEEEIEAEHTLRAKIEKQRSDLARELEEISERLEEASGATSAQIEMNKKREAEFQKMRRDLEEATLQHEATAATLRKKQADSVAELGEQIDNLQRVKQKLEKEKSELKMEIDDMASNIEALSKSKSNIERTCRTVEDQFSEIKAKDEQQTQLIHDLNMQKARLQTQNGELSHRVEEKESLISQLTKSKQALTQQLEELKRQMEEETKAKNAMAHALQSSRHDCDLLREQYEEEQEAKAELQRALSKANSEVAQWRTKYETDAIQRTEELEEAKKKLAQRLQEAEENTETANSKCASLEKTKQRLQGEVEDLMRDLERSHTACATLDKKQRNFDKVLAEWKQKLDESQAELEAAQKESRSLSTELFKMRNAYEEVVDQLETLRRENKNLQEEISDLTEQIAETGKNLQEAEKTKKLVEQEKSDLQVALEEVEGSLEHEESKILRVQLELSQVKSELDRKVIEKDEEIEQLKRNSQRAAEALQSVLDAEIRSRNDALRLKKKMEGDLNEMEIQLGHSNRQMAETQKHLRTVQGQLKDSQLHLDDALRSNEDLKEQLAIVERRNGLLLEELEEMKVALEQTERTRRLSEQELLDASDRVQLLHSQNTSLINTKKKLEADIAQCQAEVENSIQESRNAEEKAKKAITDAAMMAEELKKEQDTSAHLERMKKNLEQTVKDLQHRLDEAEQLALKGGKKQIQKLENRVRELENELDVEQKRGAEALKGAHKYERKVKEMTYQAEEDHKNILRLQDLVDKLQAKVKSYKRQAEEAEEQANTQLSRCRRVQHELEEAAERADIAESQVNKLRAKSRDVGSQKMEE

SEQ ID NO: 54513 - protein, 1938 aa, Homo sapiens; identical to SEQ ID NO: 54512
  Payload ID: 10759
  Gene Symbol: MYH13
  Gene Name: myosin, heavy chain 13, skeletal muscle
  Uniprot ID: Q9UKX3
  ENSP ID: ENSP00000404570

SEQ ID NO: 54514 - protein, 1938 aa, Homo sapiens; identical to SEQ ID NO: 54512
  Payload ID: 10759
  Gene Symbol: MYH13
  Gene Name: myosin, heavy chain 13, skeletal muscle
  Uniprot ID: Q9UKX3
  ENSP ID: ENSP00000480864

SEQ ID NO: 54515 - protein, 508 aa, Homo sapiens
  Payload ID: 10760
  Gene Symbol: MYH14
  Gene Name: myosin, heavy chain 14, non-muscle
  ENSP ID: ENSP00000262269
MKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERPRQRAGSVRLGPCH

SEQ ID NO: 54516 - protein, 1995 aa, Homo sapiens
  Payload ID: 10760
  Gene Symbol: MYH14
  Gene Name: myosin, heavy chain 14, non-muscle
  Uniprot ID: Q7Z406
  ENSP ID: ENSP00000366169
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 54517 - protein, 638 aa, Homo sapiens
  Payload ID: 10760
  Gene Symbol: MYH14
  Gene Name: myosin, heavy chain 14, non-muscle
  ENSP ID: ENSP00000406273
MEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 54518 - protein, 2003 aa, Homo sapiens
  Payload ID: 10760
  Gene Symbol: MYH14
  Gene Name: myosin, heavy chain 14, non-muscle
  Uniprot ID: Q7Z406
  ENSP ID: ENSP00000407879
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPASVSTVSYGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 54519 - protein, 1002 aa, Homo sapiens
  Payload ID: 10760
  Gene Symbol: MYH14
  Gene Name: myosin, heavy chain 14, non-muscle
  ENSP ID: ENSP00000469573
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPASVSTVSYGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTE

SEQ ID NO: 54520 - protein, 2036 aa, Homo sapiens
  Payload ID: 10760
  Gene Symbol: MYH14
  Gene Name: myosin, heavy chain 14, non-muscle
  Uniprot ID: Q7Z406
  ENSP ID: ENSP00000470298
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPASVSTVSYGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDEHGGFQQFSFLGSFPPSPPGSAERCSSAISPPGVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 54521 - protein, 2003 aa, Homo sapiens; identical to SEQ ID NO: 54518
  Payload ID: 10760
  Gene Symbol: MYH14
  Gene Name: myosin, heavy chain 14, non-muscle
  Uniprot ID: Q7Z406
  ENSP ID: ENSP00000472543

SEQ ID NO: 54522 - protein, 1995 aa, Homo sapiens; identical to SEQ ID NO: 54516
  Payload ID: 10760
  Gene Symbol: MYH14
  Gene Name: myosin, heavy chain 14, non-muscle
  Uniprot ID: Q7Z406
  ENSP ID: ENSP00000472819

SEQ ID NO: 54523 - protein, 1946 aa, Homo sapiens
  Payload ID: 10761
  Gene Symbol: MYH15
  Gene Name: myosin, heavy chain 15
  Uniprot ID: Q9Y2K3
  ENSP ID: ENSP00000273353
MVESCLLTFRAFFWWIALIKMDLSDLGEAAAFLRRSEAELLLLQATALDGKKKCWIPDGENAYIEAEVKGSEDDGTVIVETADGESLSIKEDKIQQMNPPEFEMIEDMAMLTHLNEASVLHTLKRRYGQWMIYTYSGLFCVTINPYKWLPVYQKEVMAAYKGKRRSEAPPHIFAVANNAFQDMLHNRENQSILFTGESGAGKTVNSKHIIQYFATIAAMIESRKKQGALEDQIMQANTILEAFGNAKTLRNDNSSRFGKFIRMHFGARGMLSSVDIDIYLLEKSRVIFQQAGERNYHIFYQILSGQKELHDLLLVSANPSDFHFCSCGAVTVESLDDAEELLATEQAMDILGFLPDEKYGCYKLTGAIMHFGNMKFKQKPREEQLEADGTENADKAAFLMGINSSELVKCLIHPRIKVGNEYVTRGQTIEQVTCAVGALSKSMYERMFKWLVARINRALDAKLSRQFFIGILDITGFEILEYNSLEQLCINFTNEKLQQFFNWHMFVLEQEEYKKESIEWVSIGFGLDLQACIDLIEKPMGILSILEEECMFPKATDLTFKTKLFDNHFGKSVHLQKPKPDKKKFEAHFELVHYAGVVPYNISGWLEKNKDLLNETVVAVFQKSSNRLLASLFENYMSTDSAIPFGEKKRKKGASFQTVASLHKENLNKLMTNLKSTAPHFVRCINPNVNKIPGILDPYLVLQQLRCNGVLEGTRICREGFPNRLQYADFKQRYCILNPRTFPKSKFVSSRKAAEELLGSLEIDHTQYRFGITKVFFKAGFLGQLEAIRDERLSKVFTLFQARAQGKLMRIKFQKILEERDALILIQWNIRAFMAVKNWPWMRLFFKIKPLVKSSEVGEEVAGLKEECAQLQKALEKSEFQREELKAKQVSLTQEKNDLILQLQAEQETLANVEEQCEWLIKSKIQLEARVKELSERVEEEEEINSELTARGRKLEDECFELKKEIDDLETMLVKSEKEKRTTEHKVKNLTEEVEFLNEDISKLNRAAKVVQEAHQQTLDDLHMEEEKLSSLSKANLKLEQQVDELEGALEQERKARMNCERELHKLEGNLKLNRESMENLESSQRHLAEELRKKELELSQMNSKVENEKGLVAQLQKTVKELQTQIKDLKEKLEAERTTRAKMERERADLTQDLADLNERLEEVGGSSLAQLEITKKQETKFQKLHRDMEEATLHFETTSASLKKRHADSLAELEGQVENLQQVKQKLEKDKSDLQLEVDDLLTRVEQMTRAKANAEKLCTLYEERLHEATAKLDKVTQLANDLAAQKTKLWSESGEFLRRLEEKEALINQLSREKSNFTRQIEDLRGQLEKETKSQSALAHALQKAQRDCDLLREQYEEEQEVKAELHRTLSKVNAEMVQWRMKYENNVIQRTEDLEDAKKELAIRLQEAAEAMGVANARNASLERARHQLQLELGDALSDLGKVRSAAARLDQKQLQSGKALADWKQKHEESQALLDASQKEVQALSTELLKLKNTYEESIVGQETLRRENKNLQEEISNLTNQVREGTKNLTEMEKVKKLIEEEKTEVQVTLEETEGALERNESKILHFQLELLEAKAELERKLSEKDEEIENFRRKQQCTIDSLQSSLDSEAKSRIEVTRLKKKMEEDLNEMELQLSCANRQVSEATKSLGQLQIQIKDLQMQLDDSTQLNSDLKEQVAVAERRNSLLQSELEDLRSLQEQTERGRRLSEEELLEATERINLFYTQNTSLLSQKKKLEADVARMQKEAEEVVQECQNAEEKAKKAAIEAANLSEELKKKQDTIAHLERTRENMEQTITDLQKRLAEAEQMALMGSRKQIQKLESRVRELEGELEGEIRRSAEAQRGARRLERCIKELTYQAEEDKKNLSRMQTQMDKLQLKVQNYKQQVEVAETQANQYLSKYKKQQHELNEVKERAEVAESQVNKLKIKAREFGKKVQEE

SEQ ID NO: 54524 - protein, 1941 aa, Homo sapiens
  Payload ID: 10762
  Gene Symbol: MYH2
  Gene Name: myosin, heavy chain 2, skeletal muscle, adult
  Uniprot ID: Q9UKX2
  ENSP ID: ENSP00000245503
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPVYKPEVVTAYRGKKRQEAPPHIFSISDNAYQFMLTDRENQSILITGESGAGKTVNTKRVIQYFATIAVTGEKKKEEITSGKIQGTLEDQIISANPLLEAFGNAKTVRNDNSSRFGKFIRIHFGTTGKLASADIETYLLEKSRVVFQLKAERSYHIFYQITSNKKPELIEMLLITTNPYDYPFVSQGEISVASIDDQEELMATDSAIDILGFTNEEKVSIYKLTGAVMHYGNLKFKQKQREEQAEPDGTEVADKAAYLQSLNSADLLKALCYPRVKVGNEYVTKGQTVEQVSNAVGALAKAVYEKMFLWMVARINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYDQHLGKSANFQKPKVVKGKAEAHFALIHYAGVVDYNITGWLEKNKDPLNETVVGLYQKSAMKTLAQLFSGAQTAEGEGAGGGAKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLASIDIDHTQYKFGHTKVFFKAGLLGLLEEMRDDKLAQLITRTQARCRGFLARVEYQRMVERREAIFCIQYNIRSFMNVKHWPWMKLFFKIKPLLKSAETEKEMATMKEEFQKIKDELAKSEAKRKELEEKMVTLLKEKNDLQLQVQAEAEGLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKLRMDLERAKRKLEGDLKLAQESIMDIENEKQQLDEKLKKKEFEISNLQSKIEDEQALGIQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNVETVSKAKGNLEKMCRTLEDQLSELKSKEEEQQRLINDLTAQRGRLQTESGEFSRQLDEKEALVSQLSRGKQAFTQQIEELKRQLEEEIKAKNALAHALQSSRHDCDLLREQYEEEQESKAELQRALSKANTEVAQWRTKYETDAIQRTEELEEAKKKLAQRLQAAEEHVEAVNAKCASLEKTKQRLQNEVEDLMLDVERTNAACAALDKKQRNFDKILAEWKQKCEETHAELEASQKEARSLGTELFKIKNAYEESLDQLETLKRENKNLQQEISDLTEQIAEGGKRIHELEKIKKQVEQEKCELQAALEEAEASLEHEEGKILRIQLELNQVKSEVDRKIAEKDEEIDQLKRNHIRIVESMQSTLDAEIRSRNDAIRLKKKMEGDLNEMEIQLNHANRMAAEALRNYRNTQGILKDTQIHLDDALRSQEDLKEQLAMVERRANLLQAEIEELRATLEQTERSRKIAEQELLDASERVQLLHTQNTSLINTKKKLETDISQMQGEMEDILQEARNAEEKAKKAITDAAMMAEELKKEQDTSAHLERMKKNMEQTVKDLQLRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLAKFRKLQHELEEAEERADIAESQVNKLRVKSREVHTKVISEE

SEQ ID NO: 54525 - protein, 1941 aa, Homo sapiens; identical to SEQ ID NO: 54524
  Payload ID: 10762
  Gene Symbol: MYH2
  Gene Name: myosin, heavy chain 2, skeletal muscle, adult
  Uniprot ID: Q9UKX2
  ENSP ID: ENSP00000380367

SEQ ID NO: 54526 - protein, 182 aa, Homo sapiens
  Payload ID: 10762
  Gene Symbol: MYH2
  Gene Name: myosin, heavy chain 2, skeletal muscle, adult
  ENSP ID: ENSP00000399348
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPVYKPEVVTAYRGKKRQEAPPHIFSISDNAYQFMLTDRENQSILITGESG

SEQ ID NO: 54527 - protein, 708 aa, Homo sapiens
  Payload ID: 10762
  Gene Symbol: MYH2
  Gene Name: myosin, heavy chain 2, skeletal muscle, adult
  Uniprot ID: Q9UKX2
  ENSP ID: ENSP00000433944
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPVYKPEVVTAYRGKKRQEAPPHIFSISDNAYQFMLTDRENQSILITGESGAGKTVNTKRVIQYFATIAVTGEKKKEEITSGKIQGTLEDQIISANPLLEAFGNAKTVRNDNSSRFGKFIRIHFGTTGKLASADIETYLLEKSRVVFQLKAERSYHIFYQITSNKKPELIEMLLITTNPYDYPFVSQGEISVASIDDQEELMATDSAIDILGFTNEEKVSIYKLTGAVMHYGNLKFKQKQREEQAEPDGTEVADKAAYLQSLNSADLLKALCYPRVKVGNEYVTKGQTVEQVSNAVGALAKAVYEKMFLWMVARINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYDQHLGKSANFQKPKVVKGKAEAHFALIHYAGVVDYNITGWLEKNKDPLNETVVGLYQKSAMKTLAQLFSGAQTAEGEGAGGGAKKGGKKKGSSFQTVSALFREEQSNTNLAKFRKLQHELEEAEERADIAESQVNKLRVKSREVHTKVISEE

SEQ ID NO: 54528 - protein, 155 aa, Homo sapiens
  Payload ID: 10762
  Gene Symbol: MYH2
  Gene Name: myosin, heavy chain 2, skeletal muscle, adult
  ENSP ID: ENSP00000463668
MNPPKYDKIEDMAMMTHLHEPAVLYNLKERYAAWMIYTYSGLFCVTVNPYKWLPVYKPEVVTAYRGKKRQEAPPHIFSISDNAYQFMLTDRENQSILITGESGAGKTVNTKRVIQYFATIAVTGEKKKEEITSGKIQGTLEDQIISANPLLEAFG

SEQ ID NO: 54529 - protein, 708 aa, Homo sapiens; identical to SEQ ID NO: 54527
  Payload ID: 10762
  Gene Symbol: MYH2
  Gene Name: myosin, heavy chain 2, skeletal muscle, adult
  Uniprot ID: Q9UKX2
  ENSP ID: ENSP00000482463

SEQ ID NO: 54530 - protein, 1940 aa, Homo sapiens
  Payload ID: 10763
  Gene Symbol: MYH3
  Gene Name: myosin, heavy chain 3, skeletal muscle, embryonic
  Uniprot ID: P11055
  ENSP ID: ENSP00000464317
MSSDTEMEVFGIAAPFLRKSEKERIEAQNQPFDAKTYCFVVDSKEEYAKGKIKSSQDGKVTVETEDNRTLVVKPEDVYAMNPPKFDRIEDMAMLTHLNEPAVLYNLKDRYTSWMIYTYSGLFCVTVNPYKWLPVYNPEVVEGYRGKKRQEAPPHIFSISDNAYQFMLTDRENQSILITGESGAGKTVNTKRVIQYFATIAATGDLAKKKDSKMKGTLEDQIISANPLLEAFGNAKTVRNDNSSRFGKFIRIHFGTTGKLASADIETYLLEKSRVTFQLKAERSYHIFYQILSNKKPELIELLLITTNPYDYPFISQGEILVASIDDAEELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRAEAHFSLIHYAGTVDYSVSGWLEKNKDPLNETVVGLYQKSSNRLLAHLYATFATADADSGKKKVAKKKGSSFQTVSALFRENLNKLMSNLRTTHPHFVRCIIPNETKTPGAMEHSLVLHQLRCNGVLEGIRICRKGFPNRILYGDFKQRYRVLNASAIPEGQFIDSKKACEKLLASIDIDHTQYKFGHTKVFFKAGLLGTLEEMRDDRLAKLITRTQAVCRGFLMRVEFQKMVQRRESIFCIQYNIRSFMNVKHWPWMKLFFKIKPLLKSAETEKEMATMKEEFQKTKDELAKSEAKRKELEEKLVTLVQEKNDLQLQVQAESENLLDAEERCDQLIKAKFQLEAKIKEVTERAEDEEEINAELTAKKRKLEDECSELKKDIDDLELTLAKVEKEKHATENKVKNLTEELSGLDETIAKLTREKKALQEAHQQALDDLQAEEDKVNSLNKTKSKLEQQVEDLESSLEQEKKLRVDLERNKRKLEGDLKLAQESILDLENDKQQLDERLKKKDFEYCQLQSKVEDEQTLGLQFQKKIKELQARIEELEEEIEAERATRAKTEKQRSDYARELEELSERLEEAGGVTSTQIELNKKREAEFLKLRRDLEEATLQHEAMVAALRKKHADSVAELGEQIDNLQRVKQKLEKEKSEFKLEIDDLSSSMESVSKSKANLEKICRTLEDQLSEARGKNEEIQRSLSELTTQKSRLQTEAGELSRQLEEKESIVSQLSRSKQAFTQQTEELKRQLEEENKAKNALAHALQSSRHDCDLLREQYEEEQEGKAELQRALSKANSEVAQWRTKYETDAIQRTEELEEAKKKLAQRLQDSEEQVEAVNAKCASLEKTKQRLQGEVEDLMVDVERANSLAAALDKKQRNFDKVLAEWKTKCEESQAELEASLKESRSLSTELFKLKNAYEEALDQLETVKRENKNLEQEIADLTEQIAENGKTIHELEKSRKQIELEKADIQLALEEAEAALEHEEAKILRIQLELTQVKSEIDRKIAEKDEEIEQLKRNYQRTVETMQSALDAEVRSRNEAIRLKKKMEGDLNEIEIQLSHANRQAAETLKHLRSVQGQLKDTQLHLDDALRGQEDLKEQLAIVERRANLLQAEVEELRATLEQTERARKLAEQELLDSNERVQLLHTQNTSLIHTKKKLETDLMQLQSEVEDASRDARNAEEKAKKAITDAAMMAEELKKEQDTSAHLERMKKNLEQTVKDLQHRLDEAEQLALKGGKKQIQKLETRIRELEFELEGEQKKNTESVKGLRKYERRVKELTYQSEEDRKNVLRLQDLVDKLQVKVKSYKRQAEEADEQANAHLTKFRKAQHELEEAEERADIAESQVNKLRAKTRDFTSSRMVVHESEE

SEQ ID NO: 54531 - protein, 1939 aa, Homo sapiens
  Payload ID: 10764
  Gene Symbol: MYH4
  Gene Name: myosin, heavy chain 4, skeletal muscle
  Uniprot ID: Q9Y623
  ENSP ID: ENSP00000255381
MSSDSEMAIFGEAAPFLRKSEKERIEAQNKPFDAKTSVFVVDPKESYVKAIVQSREGGKVTAKTEAGATVTVKEDQVFSMNPPKYDKIEDMAMMTHLHEPAVLYNLKERYAAWMIYTYSGLFCVTVNPYKWLPVYNPEVVTAYRGKKRQEAPPHIFSISDNAYQFMLTDRENQSILITGESGAGKTVNTKRVIQYFATIAVTGEKKKEEPASGKMQGTLEDQIISANPLLEAFGNAKTVRNDNSSRFGKFIRIHFGATGKLASADIETYLLEKSRVTFQLKAERSYHIFYQILSNKKPELIEMLLITTNPYDFAFVSQGEITVPSIDDQEELMATDSAVDILGFTADEKVAIYKLTGAVMHYGNMKFKQKQREEQAEPDGTEVADKAAYLTSLNSADLLKSLCYPRVKVGNEFVTKGQTVQQVYNAVGALAKAIYEKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYEQHLGKSNNFQKPKPAKGKPEAHFSLVHYAGTVDYNIAGWLDKNKDPLNETVVGLYQKSAMKTLAFLFSGAQTAEAEGGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIEIDHTQYKFGHTKVFFKAGLLGTLEEMRDEKLAQLITRTQAICRGFLMRVEFRKMMERRESIFCIQYNIRAFMNVKHWPWMKLYFKIKPLLKSAETEKEMANMKEEFEKTKEELAKTEAKRKELEEKMVTLMQEKNDLQLQVQAEADALADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQMEEDKVNTLTKAKTKLEQQVDDLEGSLEQEKKLCMDLERAKRKLEGDLKLAQESTMDTENDKQQLNEKLKKKEFEMSNLQGKIEDEQALAIQLQKKIKELQARIEELEEEIEAERASRAKAEKQRSDLSRELEEISERLEEAGGATSAQIEMNKKREAEFQKMRRDLEESTLQHEATAAALRKKHADSVAELGEQIDSLQRVKQKLEKEKSELKMEINDLASNMETVSKAKANFEKMCRTLEDQLSEIKTKEEEQQRLINELSAQKARLHTESGEFSRQLDEKDAMVSQLSRGKQAFTQQIEELKRQLEEETKAKSTLAHALQSARHDCDLLREQYEEEQEAKAELQRGMSKANSEVAQWRTKYETDAIQRTEELEEAKKKLAQRLQDAEEHVEAVNSKCASLEKTKQRLQNEVEDLMIDVERSNAACIALDKKQRNFDKVLAEWKQKYEETQAELEASQKESRSLSTELFKVKNAYEESLDHLETLKRENKNLQQEISDLTEQIAEGGKHIHELEKVKKQLDHEKSELQTSLEEAEASLEHEEGKILRIQLELNQVKSEIDRKIAEKDEELDQLKRNHLRVVESMQSTLDAEIRSRNDALRIKKKMEGDLNEMEIQLNHANRQAAEALRNLRNTQGILKDTQLHLDDAIRGQDDLKEQLAMVERRANLMQAEVEELRASLERTERGRKMAEQELLDASERVQLLHTQNTSLINTKKKLETDISQIQGEMEDIVQEARNAEEKAKKAITDAAMMAEELKKEQDTSAHLERMKKNMEQTVKDLQLRLDEAEQLALKGGKKQIQKLEARVRELESEVESEQKHNVEAVKGLRKHERRVKELTYQTEEDRKNILRLQDLVDKLQTKVKAYKRQAEEAEEQSNVNLAKFRKLQHELEEAKERADIAESQVNKLRVKSREVHTKVISEE

SEQ ID NO: 54532 - protein, 1939 aa, Homo sapiens
  Payload ID: 10765
  Gene Symbol: MYH6
  Gene Name: myosin, heavy chain 6, cardiac muscle, alpha
  Uniprot ID: P13533
  ENSP ID: ENSP00000348634
MTDAQMADFGAAAQYLRKSEKERLEAQTRPFDIRTECFVPDDKEEFVKAKILSREGGKVIAETENGKTVTVKEDQVLQQNPPKFDKIEDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQVLALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMESDLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQTEEDKKNLLRLQDLVDKLQLKVKAYKRQAEEAEEQANTNLSKFRKVQHELDEAEERADIAESQVNKLRAKSRDIGAKQKMHDEE

SEQ ID NO: 54533 - protein, 1939 aa, Homo sapiens; identical to SEQ ID NO: 54532
  Payload ID: 10765
  Gene Symbol: MYH6
  Gene Name: myosin, heavy chain 6, cardiac muscle, alpha
  Uniprot ID: P13533
  ENSP ID: ENSP00000386041

SEQ ID NO: 54534 - protein, 1935 aa, Homo sapiens
  Payload ID: 10766
  Gene Symbol: MYH7
  Gene Name: myosin, heavy chain 7, cardiac muscle, beta
  Uniprot ID: P12883
  ENSP ID: ENSP00000347507
MGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVIYATGALAKAVYERMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLFDNHLGKSANFQKPRNIKGKPEAHFSLIHYAGIVDYNIIGWLQKNKDPLNETVVGLYQKSSLKLLSTLFANYAGADAPIEKGKGKAKKGSSFQTVSALHRENLNKLMTNLRSTHPHFVRCIIPNETKSPGVMDNPLVMHQLRCNGVLEGIRICRKGFPNRILYGDFRQRYRILNPAAIPEGQFIDSRKGAEKLLSSLDIDHNQYKFGHTKVFFKAGLLGLLEEMRDERLSRIITRIQAQSRGVLARMEYKKLLERRDSLLVIQWNIRAFMGVKNWPWMKLYFKIKPLLKSAEREKEMASMKEEFTRLKEALEKSEARRKELEEKMVSLLQEKNDLQLQVQAEQDNLADAEERCDQLIKNKIQLEAKVKEMNERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQQVDDLEGSLEQEKKVRMDLERAKRKLEGDLKLTQESIMDLENDKQQLDERLKKKDFELNALNARIEDEQALGSQLQKKLKELQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQEAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 54535 - protein, 1983 aa, Homo sapiens
  Payload ID: 10767
  Gene Symbol: MYH7B
  Gene Name: myosin, heavy chain 7B, cardiac muscle, beta
  Uniprot ID: A7E2Y1
  ENSP ID: ENSP00000262873
MSGNKRGSRASCPHRGAECLLPWAALNLQGFQLLLLHPSATAMMDVSELGESARYLRQGYQEMTKVHTIPWDGKKRVWVPDEQDAYVEAEVKSEATGGRVTVETKDQKVLMVREAELQPMNPPRFDLLEDMAMMTHLNEASVLHNLRQRYARWMIYTYSGLFCVTINPYKWLPVYTASVVAAYKGKRRSDSPPHIYAVADNAYNDMLRNRDNQSMLITGESGAGKTVNTKRVIQYFAIVAALGDGPGKKAQFLATKTGGTLEDQIIEANPAMEAFGNAKTLRNDNSSRFGKFIRIHFGPSGKLASADIDSYLLEKSRVIFQLPGERSYHVYYQILSGRKPELQDMLLLSMNPYDYHFCSQGVITVDNMNDGEELIATDHAMDILGFSVDEKCACYKIVGALLHFGNMKFKQKQREEQAEADGTESADKAAYLMGVSSGDLLKGLLHPRVRVGNEYVTKGQSVEQVVFAVGALAKATYDRLFRWLVSRINQTLDTKLPRQFFIGVLDIAGFEIFEFNSFEQLCINFTNEKLQQFFNQHMFVLEQEEYKREGIDWVFIDFGLDLQPCIDLIEKPLGILSILEEECMFPKASDASFRAKLYDNHAGKSPNFQQPRPDKKRKYQAHFEVVHYAGVVPYSIVGWLEKNKDPLNETVVPIFQKSQNRLLATLYENYAGSCSTEPPKSGVKEKRKKAASFQTVSQLHKENLNKLMTNLRATQPHFVRCIVPNENKTPGVMDAFLVLHQLRCNGVLEGIRICRQGFPNRLLYTDFRQRYRILNPSAIPDDTFMDSRKATEKLLGSLDLDHTQYQFGHTKVFFKAGLLGVLEELRDQRLAKVLTLLQARSRGRLMRLEYQRLLGGRDALFTIQWNIRAFNAVKNWSWMKLFFKMKPLLRSAQAEEELAALRAELRGLRGALAAAEAKRQELEETHVSITQEKNDLALQLQAEQDNLADAEERCHLLIKSKVQLEGKVKELSERLEDEEEVNADLAARRRKLEDECTELKKDIDDLELTLAKAEKEKQATENKVKNLTEEMAALDESVARLTKEKKALQEAHQQALGDLQAEEDRVSALTKAKLRLEQQVEDLECSLEQEKKLRMDTERAKRKLEGDLKLTQESVADAAQDKQQLEEKLKKKDSELSQLSLRVEDEQLLGAQMQKKIKELQARAEELEEELEAERAARARVEKQRAEAARELEELSERLEEAGGASAGQREGCRKREAELGRLRRELEEAALRHEATVAALRRKQAEGAAELGEQVDSLQRVRQKLEKEKSELRMEVDDLAANVETLTRAKASAEKLCRTYEDQLSEAKIKVEELQRQLADASTQRGRLQTESGELSRLLEEKECLISQLSRGKALAAQSLEELRRQLEEESKAKSALAHAVQALRHDCDLLREQHEEEAEAQAELQRLLSKANAEVAQWRSKYEADAIQRTEELEEAKKKLALRLQEAEEGVEAANAKCSSLEKAKLRLQTESEDVTLELERATSAAAALDKKQRHLERALEERRRQEEEMQRELEAAQRESRGLGTELFRLRHGHEEALEALETLKRENKNLQEEISDLTDQVSLSGKSIQELEKTKKALEGEKSEIQAALEEAEGALELEETKTLRIQLELSQVKAEVDRKLAEKDEECANLRRNHQRAVESLQASLDAETRARNEALRLKKKMEGDLNDLELQLGHATRQATEAQAATRLMQAQLKEEQAGRDEEQRLAAELHEQAQALERRASLLAAELEELRAALEQGERSRRLAEQELLEATERLNLLHSQNTGLLNQKKKLEADLAQLSGEVEEAAQERREAEEKAKKAITDAAMMAEELKKEQDTSAHLERMKKTLEQTVRELQARLEEAEQAALRGGKKQVQKLEAKVRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKHKE

SEQ ID NO: 54536 - protein, 149 aa, Homo sapiens
  Payload ID: 10767
  Gene Symbol: MYH7B
  Gene Name: myosin, heavy chain 7B, cardiac muscle, beta
  ENSP ID: ENSP00000391939
VRELEAELDAEQKKHAEALKGVRKHERRVKELAYQVGDRVSLGSGPGAGPAQASPESPLPAQAEEDRKNLARMQDLVDKLQSKVKSYKRQFEEAEQQANTNLAKYRKAQHELDDAEERADMAETQANKLRARTRDALGPKLSLSPQHKE

SEQ ID NO: 54537 - protein, 144 aa, Homo sapiens
  Payload ID: 10767
  Gene Symbol: MYH7B
  Gene Name: myosin, heavy chain 7B, cardiac muscle, beta
  ENSP ID: ENSP00000395858
VRELEAELDAEQKKHAEALKGVRKHERRVKELAYQAEEDRKNLARMQDLVDKLQSKVKSYKRQFEEAVSALGPGHLDRAPQLCPRVCGQEQQANTNLAKYRKAQHELDDAEERADMAETQANKLRARTRDALGPKLSLSPQHKE

SEQ ID NO: 54538 - protein, 149 aa, Homo sapiens
  Payload ID: 10767
  Gene Symbol: MYH7B
  Gene Name: myosin, heavy chain 7B, cardiac muscle, beta
  ENSP ID: ENSP00000396368
VRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKVRSGRGIALCAGGLWGLTGSTAHSAIPFSSAQGVTA

SEQ ID NO: 54539 - protein, 122 aa, Homo sapiens
  Payload ID: 10767
  Gene Symbol: MYH7B
  Gene Name: myosin, heavy chain 7B, cardiac muscle, beta
  ENSP ID: ENSP00000409103
VRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKLSLSPQHKE

SEQ ID NO: 54540 - protein, 143 aa, Homo sapiens
  Payload ID: 10767
  Gene Symbol: MYH7B
  Gene Name: myosin, heavy chain 7B, cardiac muscle, beta
  ENSP ID: ENSP00000412594
VRELEAELDAEQKKHAEALKGVRKHERRVKELAYQVGDRVSLGSGPGAGPAQASPESPLPAQAEEDRKNLARMQDLVDKLQSKVKSYKRQFEEAEQQANTNLAKYRKAQHELDDAEERADMAETQANKLRARTRDALGPKHKE

SEQ ID NO: 54541 - protein, 1982 aa, Homo sapiens [sequence omitted]

SEQ ID NO: 54542 - protein, 1937 aa, Homo sapiens
  Payload ID: 10768
  Gene Symbol: MYH8
  Gene Name: myosin, heavy chain 8, skeletal muscle, perinatal
  Uniprot ID: P13535
  ENSP ID: ENSP00000384330
MSASSDAEMAVFGEAAPYLRKSEKERIEAQNKPFDAKTSVFVAEPKESYVKSTIQSKEGGKVTVKTEGGATLTVREDQVFPMNPPKYDKIEDMAMMTHLHEPGVLYNLKERYAAWMIYTYSGLFCVTVNPYKWLPVYKPEVVAAYRGKKRQEAPPHIFSISDNAYQFMLTDRENQSILITGESGAGKTVNTKRVIQYFATIAVTGEKKKDESGKMQGTLEDQIISANPLLEAFGNAKTVRNDNSSRFGKFIRIHFGTTGKLASADIETYLLEKSRVTFQLKAERSYHIFYQITSNKKPDLIEMLLITTNPYDYAFVSQGEITVPSIDDQEELMATDSAIDILGFTPEEKVSIYKLTGAVMHYGNMKFKQKQREEQAEPDGTEVADKAAYLQSLNSADLLKALCYPRVKVGNEYVTKGQTVQQVYNAVGALAKAVYEKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPLGIFSILEEECMFPKATDTSFKNKLYDQHLGKSANFQKPKVVKGKAEAHFSLIHYAGTVDYNITGWLDKNKDPLNDTVVGLYQKSAMKTLASLFSTYASAEADSSAKKGAKKKGSSFQTVSALFRENLNKLMTNLRSTHPHFVRCIIPNETKTPGAMEHELVLHQLRCNGVLEGIRICRKGFPSRILYGDFKQRYKVLNASAIPEGQFIDSKKASEKLLASIDIDHTQYKFGHTKVFFKAGLLGLLEEMRDEKLAQIITRTQAVCRGFLMRVEYQKMLQRREALFCIQYNVRAFMNVKHWPWMKLFFKIKPLLKSAETEKEMATMKEEFQKTKDELAKSEAKRKELEEKMVTLLKEKNDLQLQVQSEADSLADAEERCEQLIKNKIQLEAKIKEVTERAEEEEEINAELTAKKRKLEDECSELKKDIDDLELTLAKVEKEKHATENKVKNLTEEMAGLDETIAKLSKEKKALQETHQQTLDDLQAEEDKVNILTKAKTKLEQQVDDLEGSLEQEKKLRMDLERAKRKLEGDLKLAQESTMDMENDKQQLDEKLEKKEFEISNLISKIEDEQAVEIQLQKKIKELQARIEELGEEIEAERASRAKAEKQRSDLSRELEEISERLEEAGGATSAQVELNKKREAEFQKLRRDLEEATLQHEAMVAALRKKHADSMAELGEQIDNLQRVKQKLEKEKSELKMETDDLSSNAEAISKAKGNLEKMCRSLEDQVSELKTKEEEQQRLINDLTAQRARLQTEAGEYSRQLDEKDALVSQLSRSKQASTQQIEELKHQLEEETKAKNALAHALQSSRHDCDLLREQYEEEQEGKAELQRALSKANSEVAQWRTKYETDAIQRTEELEEAKKKLAQRLQEAEEHVEAVNAKCASLEKTKQRLQNEVEDLMLDVERSNAACAALDKKQRNFDKVLSEWKQKYEETQAELEASQKESRSLSTELFKVKNVYEESLDQLETLRRENKNLQQEISDLTEQIAEGGKQIHELEKIKKQVEQEKCEIQAALEEAEASLEHEEGKILRIQLELNQVKSEVDRKIAEKDEEIDQLKRNHTRVVETMQSTLDAEIRSRNDALRVKKKMEGDLNEMEIQLNHANRLAAESLRNYRNTQGILKETQLHLDDALRGQEDLKEQLAIVERRANLLQAEIEELWATLEQTERSRKIAEQELLDASERVQLLHTQNTSLINTKKKLENDVSQLQSEVEEVIQESRNAEEKAKKAITDAAMMAEELKKEQDTSAHLERMKKNLEQTVKDLQHRLDEAEQLALKGGKKQIQKLEARVRELEGEVENEQKRNAEAVKGLRKHERRVKELTYQTEEDRKNVLRLQDLVDKLQAKVKSYKRQAEEAEEQSNANLSKFRKLQHELEEAEERADIAESQVNKLRVKSREVHTKISAE

SEQ ID NO: 54543 - protein, 1960 aa, Homo sapiens
  Payload ID: 10769
  Gene Symbol: MYH9
  Gene Name: myosin, heavy chain 9, non-muscle
  Uniprot ID: P35579
  ENSP ID: ENSP00000216181
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 54544 - protein, 218 aa, Homo sapiens
  Payload ID: 10769
  Gene Symbol: MYH9
  Gene Name: myosin, heavy chain 9, non-muscle
  ENSP ID: ENSP00000384631
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQEAYFKNRAVRLGVL

SEQ ID NO: 54545 - protein, 103 aa, Homo sapiens
  Payload ID: 10769
  Gene Symbol: MYH9
  Gene Name: myosin, heavy chain 9, non-muscle
  ENSP ID: ENSP00000414852
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKE

SEQ ID NO: 54546 - protein, 194 aa, Homo sapiens
  Payload ID: 10770
  Gene Symbol: MYL1
  Gene Name: myosin, light chain 1, alkali
  skeletal, fast
  Uniprot ID: P05976
  ENSP ID: ENSP00000307280
MAPKKDVKKPVAAAAAAPAPAPAPAPAPAPAKPKEEKIDLSAIKIEFSKEQQDEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEKMKEEEVEALMAGQEDSNGCINYEAFVKHIMSI

SEQ ID NO: 54547 - protein, 150 aa, Homo sapiens
  Payload ID: 10770
  Gene Symbol: MYL1
  Gene Name: myosin, light chain 1, alkali
  skeletal, fast
  Uniprot ID: P05976
  ENSP ID: ENSP00000343321
MSFSADQIAEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEKMKEEEVEALMAGQEDSNGCINYEAFVKHIMSI

SEQ ID NO: 54548 - protein, 226 aa, Homo sapiens
  Payload ID: 10771
  Gene Symbol: MYL10
  Gene Name: myosin, light chain 10, regulatory
  Uniprot ID: Q9BUA6
  ENSP ID: ENSP00000223167
MLLRLVSNSWPQVILPPRPPKVLGLQAPRRARKRAEGTASSNVFSMFDQSQIQEFKESLALSPRLERNGMISAHCNLCLTGSSNSPASASQAFTIMDQNRDGFIDKEDLRDTFAALGRINVKNEELEAMVKEAPGPINFTVFLTMFGEKLKGTDPEETILHAFKVFDTEGKGFVKADVIKEKLMTQADRFSEEEVKQMFAAFPPDVCGNLDYRNLCYVITHGEEKD

SEQ ID NO: 54549 - protein, 171 aa, Homo sapiens
  Payload ID: 10772
  Gene Symbol: MYL12A
  Gene Name: myosin, light chain 12A, regulatory, non-sarcomeric
  Uniprot ID: P19105
  ENSP ID: ENSP00000217652
MSSKRTKTKTKKRPQRATSNVFAMFDQSQIQEFKEAFNMIDQNRDGFIDKEDLHDMLASLGKNPTDEYLDAMMNEAPGPINFTMFLTMFGEKLNGTDPEDVIRNAFACFDEEATGTIQEDYLRELLTTMGDRFTDEEVDELYREAPIDKKGNFNYIEFTRILKHGAKDKDD

SEQ ID NO: 54550 - protein, 171 aa, Homo sapiens; identical to SEQ ID NO: 54549
  Payload ID: 10772
  Gene Symbol: MYL12A
  Gene Name: myosin, light chain 12A, regulatory, non-sarcomeric
  Uniprot ID: P19105
  ENSP ID: ENSP00000441231

SEQ ID NO: 54551 - protein, 171 aa, Homo sapiens; identical to SEQ ID NO: 54549
  Payload ID: 10772
  Gene Symbol: MYL12A
  Gene Name: myosin, light chain 12A, regulatory, non-sarcomeric
  Uniprot ID: P19105
  ENSP ID: ENSP00000462171

SEQ ID NO: 54552 - protein, 12 aa, Homo sapiens
  Payload ID: 10772
  Gene Symbol: MYL12A
  Gene Name: myosin, light chain 12A, regulatory, non-sarcomeric
  ENSP ID: ENSP00000462865
MSSKRTKTKTKK

SEQ ID NO: 54553 - protein, 114 aa, Homo sapiens
  Payload ID: 10772
  Gene Symbol: MYL12A
  Gene Name: myosin, light chain 12A, regulatory, non-sarcomeric
  ENSP ID: ENSP00000463009
MSSKRTKTKTKKRPQRATSNVFAMFDQSQIQEFKEAFNMIDQNRDGFIDKEDLHDMLASLGKNPTDEYLDAMMNEAPGPINFTMFLTMFGEKLNGTDPEDVIRNAFACFDEEAT

SEQ ID NO: 54554 - protein, 171 aa, Homo sapiens; identical to SEQ ID NO: 54549
  Payload ID: 10772
  Gene Symbol: MYL12A
  Gene Name: myosin, light chain 12A, regulatory, non-sarcomeric
  Uniprot ID: P19105
  ENSP ID: ENSP00000463614

SEQ ID NO: 54555 - protein, 177 aa, Homo sapiens
  Payload ID: 10772
  Gene Symbol: MYL12A
  Gene Name: myosin, light chain 12A, regulatory, non-sarcomeric
  ENSP ID: ENSP00000464359
MDLTTTMSSKRTKTKTKKRPQRATSNVFAMFDQSQIQEFKEAFNMIDQNRDGFIDKEDLHDMLASLGKNPTDEYLDAMMNEAPGPINFTMFLTMFGEKLNGTDPEDVIRNAFACFDEEATGTIQEDYLRELLTTMGDRFTDEEVDELYREAPIDKKGNFNYIEFTRILKHGAKDKDD

SEQ ID NO: 54556 - protein, 172 aa, Homo sapiens
  Payload ID: 10773
  Gene Symbol: MYL12B
  Gene Name: myosin, light chain 12B, regulatory
  Uniprot ID: O14950
  ENSP ID: ENSP00000237500
MSSKKAKTKTTKKRPQRATSNVFAMFDQSQIQEFKEAFNMIDQNRDGFIDKEDLHDMLASLGKNPTDAYLDAMMNEAPGPINFTMFLTMFGEKLNGTDPEDVIRNAFACFDEEATGTIQEDYLRELLTTMGDRFTDEEVDELYREAPIDKKGNFNYIEFTRILKHGAKDKDD

SEQ ID NO: 54557 - protein, 172 aa, Homo sapiens; identical to SEQ ID NO: 54556
  Payload ID: 10773
  Gene Symbol: MYL12B
  Gene Name: myosin, light chain 12B, regulatory
  Uniprot ID: O14950
  ENSP ID: ENSP00000383037

SEQ ID NO: 54558 - protein, 172 aa, Homo sapiens; identical to SEQ ID NO: 54556
  Payload ID: 10773
  Gene Symbol: MYL12B
  Gene Name: myosin, light chain 12B, regulatory
  Uniprot ID: O14950
  ENSP ID: ENSP00000463559

SEQ ID NO: 54559 - protein, 172 aa, Homo sapiens; identical to SEQ ID NO: 54556
  Payload ID: 10773
  Gene Symbol: MYL12B
  Gene Name: myosin, light chain 12B, regulatory
  Uniprot ID: O14950
  ENSP ID: ENSP00000464464

SEQ ID NO: 54560 - protein, 166 aa, Homo sapiens
  Payload ID: 10774
  Gene Symbol: MYL2
  Gene Name: myosin, light chain 2, regulatory, cardiac, slow
  Uniprot ID: P10916
  ENSP ID: ENSP00000228841
MAPKKAKKRAGGANSNVFSMFEQTQIQEFKEAFTIMDQNRDGFIDKNDLRDTFAALGRVNVKNEEIDEMIKEAPGPINFTVFLTMFGEKLKGADPEETILNAFKVFDPEGKGVLKADYVREMLTTQAERFSKEEVDQMFAAFPPDVTGNLDYKNLVHIITHGEEKD

SEQ ID NO: 54561 - protein, 152 aa, Homo sapiens
  Payload ID: 10774
  Gene Symbol: MYL2
  Gene Name: myosin, light chain 2, regulatory, cardiac, slow
  ENSP ID: ENSP00000447154
MAPKKAKKRAGGANSNVFSMFEQTQIQEFKELGVPECVFPTLGRVNVKNEEIDEMIKEAPGPINFTVFLTMFGEKLKGADPEETILNAFKVFDPEGKGVLKADYVREMLTTQAERFSKEEVDQMFAAFPPDVTGNLDYKNLVHIITHGEEKD

SEQ ID NO: 54562 - protein, 195 aa, Homo sapiens
  Payload ID: 10775
  Gene Symbol: MYL3
  Gene Name: myosin, light chain 3, alkali
  ventricular, skeletal, slow
  Uniprot ID: P08590
  ENSP ID: ENSP00000292327
MAPKKPEPKKDDAKAAPKAAPAPAPPPEPERPKEVEFDASKIKIEFTPEQIEEFKEAFMLFDRTPKCEMKITYGQCGDVLRALGQNPTQAEVLRVLGKPRQEELNTKMMDFETFLPMLQHISKNKDTGTYEDFVEGLRVFDKEGNGTVMGAELRHVLATLGERLTEDEVEKLMAGQEDSNGCINYEAFVKHIMSS

SEQ ID NO: 54563 - protein, 195 aa, Homo sapiens; identical to SEQ ID NO: 54562
  Payload ID: 10775
  Gene Symbol: MYL3
  Gene Name: myosin, light chain 3, alkali
  ventricular, skeletal, slow
  Uniprot ID: P08590
  ENSP ID: ENSP00000379210

SEQ ID NO: 54564 - protein, 46 aa, Homo sapiens
  Payload ID: 10775
  Gene Symbol: MYL3
  Gene Name: myosin, light chain 3, alkali
  ventricular, skeletal, slow
  ENSP ID: ENSP00000393455
MAPKKPEPKKDDAKAAPKAAPAPAPPPEPERPKEVEFDASKIKIEF

SEQ ID NO: 54565 - protein, 197 aa, Homo sapiens
  Payload ID: 10776
  Gene Symbol: MYL4
  Gene Name: myosin, light chain 4, alkali
  atrial, embryonic
  Uniprot ID: P12829
  ENSP ID: ENSP00000347055
MAPKKPEPKKEAAKPAPAPAPAPAPAPAPAPEAPKEPAFDPKSVKIDFTADQIEEFKEAFSLFDRTPTGEMKITYGQCGDVLRALGQNPTNAEVLRVLGKPKPEEMNVKMLDFETFLPILQHISRNKEQGTYEDFVEGLRVFDKESNGTVMGAELRHVLATLGEKMTEAEVEQLLAGQEDANGCINYEAFVKHIMSG

SEQ ID NO: 54566 - protein, 197 aa, Homo sapiens; identical to SEQ ID NO: 54565
  Payload ID: 10776
  Gene Symbol: MYL4
  Gene Name: myosin, light chain 4, alkali
  atrial, embryonic
  Uniprot ID: P12829
  ENSP ID: ENSP00000377096

SEQ ID NO: 54567 - protein, 196 aa, Homo sapiens
  Payload ID: 10776
  Gene Symbol: MYL4
  Gene Name: myosin, light chain 4, alkali
  atrial, embryonic
  ENSP ID: ENSP00000442375
MAPKKPEPKKEAAKPAPAPAPAPAPAPAPAPEAPKEPAFDPKSVKIDFTADQIEEFKEAFSLFDRTPTGEMKITYGQCGDVLRALGQNPTNAEVLRVLGKPKPEEMNVKMLDFETFLPILQHISRNKEQGTYEDFVEGLRVFDKESNGTVMGAELRHVLATLGEKMTEAEVEQLLAGQEDANGCINYEAFVKHIMS

SEQ ID NO: 54568 - protein, 61 aa, Homo sapiens
  Payload ID: 10776
  Gene Symbol: MYL4
  Gene Name: myosin, light chain 4, alkali
  atrial, embryonic
  ENSP ID: ENSP00000458194
MAPKKPEPKKEAAKPAPAPAPAPAPAPAPAPEAPKEPAFDPKSVKSSKRPFHCLTGPRLER

SEQ ID NO: 54569 - protein, 172 aa, Homo sapiens
  Payload ID: 10776
  Gene Symbol: MYL4
  Gene Name: myosin, light chain 4, alkali
  atrial, embryonic
  ENSP ID: ENSP00000458907
MAPKKPEPKKEAAKPAPAPAPAPAPAPAPAPEAPKEPAFDPKSVKIDFTADQIEEFKEAFSLFDRTPTGEMKITYGQCGDVLRALGQNPTNAEVLRVLGKPKPEEMNVKMLDFETFLPILQHISRNKEQGTYEDFVEGLRVFDKESNGTVMGAELRHVLATLGEKMTEAEVE

SEQ ID NO: 54570 - protein, 61 aa, Homo sapiens; identical to SEQ ID NO: 54568
  Payload ID: 10776
  Gene Symbol: MYL4
  Gene Name: myosin, light chain 4, alkali
  atrial, embryonic
  ENSP ID: ENSP00000459035

SEQ ID NO: 54571 - protein, 115 aa, Homo sapiens
  Payload ID: 10776
  Gene Symbol: MYL4
  Gene Name: myosin, light chain 4, alkali
  atrial, embryonic
  ENSP ID: ENSP00000460734
MAPKKPEPKKEAAKPAPAPAPAPAPAPAPAPEAPKEPAFDPKSVKIDFTADQIEEFKEAFSLFDRTPTGEMKITYGQCGDVLRALGQNPTNAEVLRVLGKPKPEAHFPQQGAGHL

SEQ ID NO: 54572 - protein, 101 aa, Homo sapiens
  Payload ID: 10776
  Gene Symbol: MYL4
  Gene Name: myosin, light chain 4, alkali
  atrial, embryonic
  ENSP ID: ENSP00000461121
  MOD_RES (1)..(1): Any amino acid
XLGKPKPEEMNVKMLDFETFLPILQHISRNKEQGTYEDFVEGLRVFDKESNGTVMGAELRHVLATLGEKMTEAEVEQLLAGQEDANGCINYEAFVKHIMSG

SEQ ID NO: 54573 - protein, 197 aa, Homo sapiens; identical to SEQ ID NO: 54565
  Payload ID: 10776
  Gene Symbol: MYL4
  Gene Name: myosin, light chain 4, alkali
  atrial, embryonic
  Uniprot ID: P12829
  ENSP ID: ENSP00000461570

SEQ ID NO: 54574 - protein, 173 aa, Homo sapiens
  Payload ID: 10776
  Gene Symbol: MYL4
  Gene Name: myosin, light chain 4, alkali
  atrial, embryonic
  ENSP ID: ENSP00000461747
MAPKKPEPKKEAAKPAPAPAPAPAPAPAPAPEAPKEPAFDPKSVKIDFTADQIEGEYGQPHLSVSIALSWRRRRRRKKRRSSCPHEFKEAFSLFDRTPTGEMKITYGQCGDVLRALGQNPTNAEVLRVLGKPKPEEMNVKMLDFETFLPILQHISRNKEQGTYEDFVEGLRVF

SEQ ID NO: 54575 - protein, 173 aa, Homo sapiens
  Payload ID: 10777
  Gene Symbol: MYL5
  Gene Name: myosin, light chain 5, regulatory
  Uniprot ID: Q02045
  ENSP ID: ENSP00000383023
MASRKTKKKEGGALRAQRASSNVFSNFEQTQIQEFKEAFTLMDQNRDGFIDKEDLKDTYASLGKTNVKDDELDAMLKEASGPINFTMFLNLFGEKLSGTDAEETILNAFKMLDPDGKGKINKEYIKRLLMSQADKMTAEEVDQMFQFASIDVAGNLDYKALSYVITHGEEKEE

SEQ ID NO: 54576 - protein, 105 aa, Homo sapiens
  Payload ID: 10777
  Gene Symbol: MYL5
  Gene Name: myosin, light chain 5, regulatory
  ENSP ID: ENSP00000423053
MASRKTKKKEGGALRAQRASSNVFSNFEQTQIQEFKEAFTLMDQNRDGFIDKEDLKDTYASLGRYPGRTPQSPWRRRTQRSSSSRRRGPSSNGARARASEAHQRP

SEQ ID NO: 54577 - protein, 132 aa, Homo sapiens
  Payload ID: 10777
  Gene Symbol: MYL5
  Gene Name: myosin, light chain 5, regulatory
  Uniprot ID: Q02045
  ENSP ID: ENSP00000423118
MDQNRDGFIDKEDLKDTYASLGKTNVKDDELDAMLKEASGPINFTMFLNLFGEKLSGTDAEETILNAFKMLDPDGKGKINKEYIKRLLMSQADKMTAEEVDQMFQFASIDVAGNLDYKALSYVITHGEEKEE

SEQ ID NO: 54578 - protein, 64 aa, Homo sapiens
  Payload ID: 10777
  Gene Symbol: MYL5
  Gene Name: myosin, light chain 5, regulatory
  ENSP ID: ENSP00000424528
MDQNRDGFIDKEDLKDTYASLGRYPGRTPQSPWRRRTQRSSSSRRRGPSSNGARARASEAHQRP

SEQ ID NO: 54579 - protein, 132 aa, Homo sapiens; identical to SEQ ID NO: 54577
  Payload ID: 10777
  Gene Symbol: MYL5
  Gene Name: myosin, light chain 5, regulatory
  Uniprot ID: Q02045
  ENSP ID: ENSP00000425162

SEQ ID NO: 54580 - protein, 132 aa, Homo sapiens; identical to SEQ ID NO: 54577
  Payload ID: 10777
  Gene Symbol: MYL5
  Gene Name: myosin, light chain 5, regulatory
  Uniprot ID: Q02045
  ENSP ID: ENSP00000427153

SEQ ID NO: 54581 - protein, 126 aa, Homo sapiens
  Payload ID: 10777
  Gene Symbol: MYL5
  Gene Name: myosin, light chain 5, regulatory
  ENSP ID: ENSP00000427317
MVLPPQASRKTKKKEGGALRAQRASSNVFSNFEQTQIQEFKEAFTLMDQNRDGFIDKEDLKDTYASLGKTNVKDDELDAMLKEASGPINFTMFLNLFGEKLSGTDAEETILNAFKMLDPDGKGKIN

SEQ ID NO: 54582 - protein, 152 aa, Homo sapiens
  Payload ID: 10778
  Gene Symbol: MYL6
  Gene Name: myosin, light chain 6, alkali, smooth muscle and non-muscle
  ENSP ID: ENSP00000293422
MQCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 54583 - protein, 152 aa, Homo sapiens
  Payload ID: 10778
  Gene Symbol: MYL6
  Gene Name: myosin, light chain 6, alkali, smooth muscle and non-muscle
  ENSP ID: ENSP00000301540
MQCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 54584 - protein, 238 aa, Homo sapiens
  Payload ID: 10778
  Gene Symbol: MYL6
  Gene Name: myosin, light chain 6, alkali, smooth muscle and non-muscle
  ENSP ID: ENSP00000441750
MVGPRSWETGRIGDERQEETGGGRGEGRGRRQRESEDPKGWRWGWKDWGPAGKRVCSLKQEFVGQSLWVRVCGAGIETRGIGVQMLTTSLFSEQCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEGKR

SEQ ID NO: 54585 - protein, 103 aa, Homo sapiens
  Payload ID: 10778
  Gene Symbol: MYL6
  Gene Name: myosin, light chain 6, alkali, smooth muscle and non-muscle
  ENSP ID: ENSP00000446640
MCDFTEDQTAEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 54586 - protein, 145 aa, Homo sapiens
  Payload ID: 10778
  Gene Symbol: MYL6
  Gene Name: myosin, light chain 6, alkali, smooth muscle and non-muscle
  ENSP ID: ENSP00000446687
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEGKR

SEQ ID NO: 54587 - protein, 196 aa, Homo sapiens
  Payload ID: 10778
  Gene Symbol: MYL6
  Gene Name: myosin, light chain 6, alkali, smooth muscle and non-muscle
  ENSP ID: ENSP00000446709
MVGPRSWETGRIGDERQEETGGGRGEGRGRRQRESEDPKGWRWGWKDWGPAGKRVCSLKQEFVGQSLWVRVCGAGIETRGIGVQMLTTSLFSEQCDFTEDQTAEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 54588 - protein, 151 aa, Homo sapiens
  Payload ID: 10778
  Gene Symbol: MYL6
  Gene Name: myosin, light chain 6, alkali, smooth muscle and non-muscle
  Uniprot ID: P60660
  ENSP ID: ENSP00000446714
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 54589 - protein, 161 aa, Homo sapiens
  Payload ID: 10778
  Gene Symbol: MYL6
  Gene Name: myosin, light chain 6, alkali, smooth muscle and non-muscle
  ENSP ID: ENSP00000446721
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEGKRRCEGLQESCSHHNPPA

SEQ ID NO: 54590 - protein, 151 aa, Homo sapiens
  Payload ID: 10778
  Gene Symbol: MYL6
  Gene Name: myosin, light chain 6, alkali, smooth muscle and non-muscle
  Uniprot ID: P60660
  ENSP ID: ENSP00000446955
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 54591 - protein, 151 aa, Homo sapiens; identical to SEQ ID NO: 54590
  Payload ID: 10778
  Gene Symbol: MYL6
  Gene Name: myosin, light chain 6, alkali, smooth muscle and non-muscle
  Uniprot ID: P60660
  ENSP ID: ENSP00000448101

SEQ ID NO: 54592 - protein, 83 aa, Homo sapiens
  Payload ID: 10778
  Gene Symbol: MYL6
  Gene Name: myosin, light chain 6, alkali, smooth muscle and non-muscle
  ENSP ID: ENSP00000448457
  MOD_RES (1)..(1): Any amino acid
XNKDQGTYEDYVEGLRVFDKEGNGTVMGAEIRHVLVTLGEKMTEEEVEMLVAGHEDSNGCINYEGKRRCEGLQESCSHHNPPA

SEQ ID NO: 54593 - protein, 115 aa, Homo sapiens
  Payload ID: 10778
  Gene Symbol: MYL6
  Gene Name: myosin, light chain 6, alkali, smooth muscle and non-muscle
  ENSP ID: ENSP00000448859
MCDFTEDQTAEFKEAFQLFDRTEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 54594 - protein, 47 aa, Homo sapiens
  Payload ID: 10778
  Gene Symbol: MYL6
  Gene Name: myosin, light chain 6, alkali, smooth muscle and non-muscle
  ENSP ID: ENSP00000449086
MGAEIRHVLVTLGEKMTEEEVEMLVAGHEDSNGCINYEELVRMVLNG

SEQ ID NO: 54595 - protein, 130 aa, Homo sapiens
  Payload ID: 10778
  Gene Symbol: MYL6
  Gene Name: myosin, light chain 6, alkali, smooth muscle and non-muscle
  ENSP ID: ENSP00000450116
MCDFTEDQTAGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYE

SEQ ID NO: 54596 - protein, 208 aa, Homo sapiens
  Payload ID: 10779
  Gene Symbol: MYL6B
  Gene Name: myosin, light chain 6B, alkali, smooth muscle and non-muscle
  Uniprot ID: P14649
  ENSP ID: ENSP00000446643
MPPKKDVPVKKPAGPSISKPAAKPAAAGAPPAKTKAEPAVPQAPQKTQEPPVDLSKVVIEFNKDQLEEFKEAFELFDRVGDGKILYSQCGDVMRALGQNPTNAEVLKVLGNPKSDELKSRRVDFETFLPMLQAVAKNRGQGTYEDYLEGFRVFDKEGNGKVMGAELRHVLTTLGEKMTEEEVETVLAGHEDSNGCINYEAFLKHILSV

SEQ ID NO: 54597 - protein, 175 aa, Homo sapiens
  Payload ID: 10779
  Gene Symbol: MYL6B
  Gene Name: myosin, light chain 6B, alkali, smooth muscle and non-muscle
  ENSP ID: ENSP00000446965
MPPKKDVPVKKPAGPSISKPAAKPAAAGAPPAKTKAEPAVPQAPQKTQEPPVDLSKVVIEFNKDQLEEFKEAFELFDRVGDGKILYSQCGDVMRALGQNPTNAEVLKVLGNPKSDELKSRRVDFETFLPMLQAVAKNRGQGEKMTEEEVETVLAGHEDSNGCINYEAFLKHILSV

SEQ ID NO: 54598 - protein, 29 aa, Homo sapiens
  Payload ID: 10779
  Gene Symbol: MYL6B
  Gene Name: myosin, light chain 6B, alkali, smooth muscle and non-muscle
  ENSP ID: ENSP00000448198
MPPKKDVPVKKPAGPSISKPAAKPAAAGA

SEQ ID NO: 54599 - protein, 208 aa, Homo sapiens; identical to SEQ ID NO: 54596
  Payload ID: 10779
  Gene Symbol: MYL6B
  Gene Name: myosin, light chain 6B, alkali, smooth muscle and non-muscle
  Uniprot ID: P14649
  ENSP ID: ENSP00000450385

SEQ ID NO: 54600 - protein, 175 aa, Homo sapiens
  Payload ID: 10780
  Gene Symbol: MYL7
  Gene Name: myosin, light chain 7, regulatory
  Uniprot ID: Q01449
  ENSP ID: ENSP00000223364
MASRKAGTRGKVAATKQAQRGSSNVFSMFEQAQIQEFKEAFSCIDQNRDGIICKADLRETYSQLGKVSVPEEELDAMLQEGKGPINFTVFLTLFGEKLNGTDPEEAILSAFRMFDPSGKGVVNKDEFKQLLLTQADKFSPAEVEQMFALTPMDLAGNIDYKSLCYIITHGDEKEE

SEQ ID NO: 54601 - protein, 197 aa, Homo sapiens
  Payload ID: 10780
  Gene Symbol: MYL7
  Gene Name: myosin, light chain 7, regulatory
  ENSP ID: ENSP00000389202
ASRKAGTRGKVAATKQAQRGSSNVFSMFEQAQIQEFKEVSPPPPTFPRAGGCSHLKAPIPQAFSCIDQNRDGIICKADLRETYSQLGKVSVPEEELDAMLQEGKGPINFTVFLTLFGEKLNGTDPEEAILSAFRMFDPSGKGVVNKDEFKQLLLTQADKFSPAEVEQMFALTPMDLAGNIDYKSLCYIITHGDEKEE

SEQ ID NO: 54602 - protein, 38 aa, Homo sapiens
  Payload ID: 10780
  Gene Symbol: MYL7
  Gene Name: myosin, light chain 7, regulatory
  ENSP ID: ENSP00000399398
  MOD_RES (1)..(1): Any amino acid
XKAGTRGKVAATKQAQRGSSNVFSMFEQAQIQEFKEGR

SEQ ID NO: 54603 - protein, 148 aa, Homo sapiens
  Payload ID: 10780
  Gene Symbol: MYL7
  Gene Name: myosin, light chain 7, regulatory
  ENSP ID: ENSP00000403360
MFEQAQIQEFKEAFSCIDQNRDGIICKADLRETYSQLGKVSVPEEELDAMLQEGKGPINFTVFLTLFGEKLNGTDPEEAILSAFRMFDPSGKGVVNKDEFKQLLLTQADKFSPAEVEQMFALTPMDLAGNIDYKSLCYIITHGDEKEE

SEQ ID NO: 54604 - protein, 172 aa, Homo sapiens
  Payload ID: 10780
  Gene Symbol: MYL7
  Gene Name: myosin, light chain 7, regulatory
  ENSP ID: ENSP00000403988
ASRKAGTRGKVAATKQAQRGSSNVFSMFEQAQIQEFKEAFSCIDQNRDGIICKADLRETYSQLAPVARMEGGRPGPSGGHPGSLCAPHAPPPPGKVSVPEEELDAMLQEGKGPINFTVFLTLFGEKLNGTDPEEAILSAFRMFDPSGKGVVNKDEFKQLLLTQADKFSPAEV

SEQ ID NO: 54605 - protein, 31 aa, Homo sapiens
  Payload ID: 10780
  Gene Symbol: MYL7
  Gene Name: myosin, light chain 7, regulatory
  ENSP ID: ENSP00000404918
MVSACWGRKASGLPGAGLWAGGAEFSVLVLG

SEQ ID NO: 54606 - protein, 107 aa, Homo sapiens
  Payload ID: 10780
  Gene Symbol: MYL7
  Gene Name: myosin, light chain 7, regulatory
  ENSP ID: ENSP00000411340
  MOD_RES (1)..(1): Any amino acid
XPAGRRGPGARWQPPSRPNVVLPTSFPCLNKPRYRSSKKAGGCSHLKAPIPQAFSCIDQNRDGIICKADLRETYSQLGKVSVPEEELDAMLQEGKGPINFTVFLTLF

SEQ ID NO: 54607 - protein, 135 aa, Homo sapiens
  Payload ID: 10780
  Gene Symbol: MYL7
  Gene Name: myosin, light chain 7, regulatory
  ENSP ID: ENSP00000416010
LDAMLQEGKGPINFTVFLTLFGEKLNGTDPEEAILSAFRMFDPSGKGVVNKDEFKQLLLTQADKFSPAEVRLPSPFNTHPQHLLWAFTHDPEPSTSEAVAGRVEQMFALTPMDLAGNIDYKSLCYIITHGDEKEE

SEQ ID NO: 54608 - protein, 118 aa, Homo sapiens
  Payload ID: 10781
  Gene Symbol: MYL9
  Gene Name: myosin, light chain 9, regulatory
  Uniprot ID: P24844
  ENSP ID: ENSP00000217313
MSSKRAKAKTTKKRPQRATSNVFAMFDQSQIQEFKEAFNMIDQNRDGFIDKEDLHDMLASLGFIHEDHLRELLTTMGDRFTDEEVDEMYREAPIDKKGNFNYVEFTRILKHGAKDKDD

SEQ ID NO: 54609 - protein, 172 aa, Homo sapiens
  Payload ID: 10781
  Gene Symbol: MYL9
  Gene Name: myosin, light chain 9, regulatory
  Uniprot ID: P24844
  ENSP ID: ENSP00000279022
MSSKRAKAKTTKKRPQRATSNVFAMFDQSQIQEFKEAFNMIDQNRDGFIDKEDLHDMLASLGKNPTDEYLEGMMSEAPGPINFTMFLTMFGEKLNGTDPEDVIRNAFACFDEEASGFIHEDHLRELLTTMGDRFTDEEVDEMYREAPIDKKGNFNYVEFTRILKHGAKDKDD

SEQ ID NO: 54610 - protein, 375 aa, Homo sapiens
  Payload ID: 10782
  Gene Symbol: MSTN
  Gene Name: myostatin
  Uniprot ID: O14793
  ENSP ID: ENSP00000260950
MQKLQLCVYIYLFMLIVAGPVDLNENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 54611 - protein, 498 aa, Homo sapiens
  Payload ID: 10783
  Gene Symbol: MYOT
  Gene Name: myotilin
  ENSP ID: ENSP00000239926
MFNYERPKHFIQSQNPCGSRLQPPGPETSSFSSQTKQSSIIIQPRQCTEQRFSASSTLSSHITMSSSAFPASPQQHAGSNPGQRVTTTYNQSPASFLSSILPSQPDYNSSKIPSAMDSNYQQSSAGQPINAKPSQTANAKPIPRTPDHEIQGSKEALIQDLERKLKCKDTLLHNGNQRLTYEEKMARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 54612 - protein, 314 aa, Homo sapiens
  Payload ID: 10783
  Gene Symbol: MYOT
  Gene Name: myotilin
  Uniprot ID: Q9UBF9
  ENSP ID: ENSP00000391185
MARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 54613 - protein, 383 aa, Homo sapiens
  Payload ID: 10783
  Gene Symbol: MYOT
  Gene Name: myotilin
  ENSP ID: ENSP00000426281
MDSNYQQSSAGQPINAKPSQTANAKPIPRTPDHEIQGSKEALIQDLERKLKCKDTLLHNGNQRLTYEEKMARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 54614 - protein, 118 aa, Homo sapiens
  Payload ID: 10784
  Gene Symbol: MTPN
  Gene Name: myotrophin
  Uniprot ID: P58546
  ENSP ID: ENSP00000376800
MCDKEFMWALKNGDLDEVKDYVAKGEDVNRTLEGGRKPLHYAADCGQLEILEFLLLKGADINAPDKHHITPLLSAVYEGHVSCVKLLLSKGADKTVKGPDGLTAFEATDNQAIKALLQ

SEQ ID NO: 54615 - protein, 52 aa, Homo sapiens
  Payload ID: 10784
  Gene Symbol: MTPN
  Gene Name: myotrophin
  ENSP ID: ENSP00000388321
MCDKEFMWALKNGDLDEVKDYVAKGADKTVKGPDGLTAFEATDNQAIKALLQ

SEQ ID NO: 54616 - protein, 603 aa, Homo sapiens
  Payload ID: 10785
  Gene Symbol: MTM1
  Gene Name: myotubularin 1
  Uniprot ID: Q13496
  ENSP ID: ENSP00000359423
MASASTSKYNSHSLENESIKRTSRDGVNRDLTEAVPRLPGETLITDKEVIYICPFNGPIKGRVYITNYRLYLRSLETDSSLILDVPLGVISRIEKMGGATSRGENSYGLDITCKDMRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESLKKVKDIVYPNVEESHWLSSLESTHWLEHIKLVLTGAIQVADKVSSGKSSVLVHCSDGWDRTAQLTSLAMLMLDSFYRSIEGFEILVQKEWISFGHKFASRIGHGDKNHTDADRSPIFLQFIDCVWQMSKQFPTAFEFNEQFLIIILDHLYSCRFGTFLFNCESARERQKVTERTVSLWSLINSNKEKFKNPFYTKEINRVLYPVASMRHLELWVNYYIRWNPRIKQQQPNPVEQRYMELLALRDEYIKRLEELQLANSAKLSDPPTSPSSPSQMMPHVQTHF

SEQ ID NO: 54617 - protein, 103 aa, Homo sapiens
  Payload ID: 10785
  Gene Symbol: MTM1
  Gene Name: myotubularin 1
  ENSP ID: ENSP00000400699
MASASTSKYNSHSLENESIKRTSRDGVNRDLTEAVPRLPGETLITDKEVIYICPFNGPIKGRVYITNYRLYLRSLETPLFAFLNEEKFNVDGWTVYNPVEEYR

SEQ ID NO: 54618 - protein, 665 aa, Homo sapiens
  Payload ID: 10786
  Gene Symbol: MTMR1
  Gene Name: myotubularin related protein 1
  Uniprot ID: Q13613
  ENSP ID: ENSP00000359417
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 54619 - protein, 132 aa, Homo sapiens
  Payload ID: 10786
  Gene Symbol: MTMR1
  Gene Name: myotubularin related protein 1
  ENSP ID: ENSP00000389884
HVEWCKQLIAATISSQISGSVTSENVSRDYKVFRRPDLRNIHKARQRLALRDGNKLAQMEEAPLFPGESIKAIVKDVMYICPFMGAVSGTLTVTDFKLYFKNVERDPHFILDVPLGVISRVEKIGAQSHGDN

SEQ ID NO: 54620 - protein, 87 aa, Homo sapiens
  Payload ID: 10786
  Gene Symbol: MTMR1
  Gene Name: myotubularin related protein 1
  ENSP ID: ENSP00000390736
MEEAPLFPGESIKAIVKDVMYICPFMGAVSGTLTVTDFKLYFKNVERDPHFILDVPLGVISRVEKIGAQSHGDNSCGIEIVCKDMRN

SEQ ID NO: 54621 - protein, 90 aa, Homo sapiens
  Payload ID: 10786
  Gene Symbol: MTMR1
  Gene Name: myotubularin related protein 1
  ENSP ID: ENSP00000404599
MEEAPLFPGESIKAIVKDVMYICPFMGAVSGTLTVTDFKLYFKNVERDPHFILDVPLGVISRVEKIGAQSHGDNSCGIEIVCKDMRNLRL

SEQ ID NO: 54622 - protein, 87 aa, Homo sapiens; identical to SEQ ID NO: 54620
  Payload ID: 10786
  Gene Symbol: MTMR1
  Gene Name: myotubularin related protein 1
  ENSP ID: ENSP00000405946

SEQ ID NO: 54623 - protein, 673 aa, Homo sapiens
  Payload ID: 10786
  Gene Symbol: MTMR1
  Gene Name: myotubularin related protein 1
  ENSP ID: ENSP00000414178
MDRPAAAAAAGCEGGGGPNPGPAGGRRPPRAAGGATAGSRQPSVETLDSPTGSHVEWCKQLIAATISSQISGSVTSENVSRDYKVFRRPDLRALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 54624 - protein, 149 aa, Homo sapiens
  Payload ID: 10786
  Gene Symbol: MTMR1
  Gene Name: myotubularin related protein 1
  ENSP ID: ENSP00000414925
HVEWCKQLIAATISSQISGSVTSENVSRDYKVFRRPDLRNIHKARQRLEIQEEHNGYPSEAEADQALRDGNKLAQMEEAPLFPGESIKAIVKDVMYICPFMGAVSGTLTVTDFKLYFKNVERDPHFILDVPLGVISRVEKIGAQSHGDN

SEQ ID NO: 54625 - protein, 147 aa, Homo sapiens
  Payload ID: 10786
  Gene Symbol: MTMR1
  Gene Name: myotubularin related protein 1
  ENSP ID: ENSP00000431992
MEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGL

SEQ ID NO: 54626 - protein, 568 aa, Homo sapiens
  Payload ID: 10786
  Gene Symbol: MTMR1
  Gene Name: myotubularin related protein 1
  Uniprot ID: Q13613
  ENSP ID: ENSP00000434105
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEAWGAGTQRARGSLRSR

SEQ ID NO: 54627 - protein, 405 aa, Homo sapiens
  Payload ID: 10786
  Gene Symbol: MTMR1
  Gene Name: myotubularin related protein 1
  ENSP ID: ENSP00000434514
  MOD_RES (1)..(1): Any amino acid
XGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEAWGAGTQRARGSLRSR

SEQ ID NO: 54628 - protein, 185 aa, Homo sapiens
  Payload ID: 10786
  Gene Symbol: MTMR1
  Gene Name: myotubularin related protein 1
  ENSP ID: ENSP00000436957
MDRPAAAAAAGCEGGGGPNPGPAGGRRPPRAAGGATAGSRQPSVETLDSPTGSHVEWCKQLIAATISSQISGSVTSENVSRDYKEIQEEHNGYPSEAEADQALRDGNKLAQMEEAPLFPGESIKAIVKDVMYICPFMGAVSGTLTVTDFKLYFKNVERDPHFILDVPLGVISRVEKIGAQSHGDN

SEQ ID NO: 54629 - protein, 363 aa, Homo sapiens
  Payload ID: 10786
  Gene Symbol: MTMR1
  Gene Name: myotubularin related protein 1
  ENSP ID: ENSP00000445281
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKLWYQDTASLME

SEQ ID NO: 54630 - protein, 777 aa, Homo sapiens
  Payload ID: 10787
  Gene Symbol: MTMR10
  Gene Name: myotubularin related protein 10
  Uniprot ID: Q9NXD2
  ENSP ID: ENSP00000402537
MFSLKPPKPTFRSYLLPPPQTDDKINSEPKIKKLEPVLLPGEIVVNEVNFVRKCIATDTSQYDLWGKLICSNFKISFITDDPMPLQKFHYRNLLLGEHDVPLTCIEQIVTVNDHKRKQKVLGPNQKLKFNPTELIIYCKDFRIVRFRFDESGPESAKKVCLAIAHYSQPTDLQLLFAFEYVGKKYHNSANKINGIPSGDGGGGGGGGNGAGGGSSQKTPLFETYSDWDREIKRTGASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTEFAISKNIQLGDEKGLKFPSVWDWSLQFTAKDRTLFHNPFYIGKSTPCIQNGSVKSFKRTKKSYSSTLRGMPSALKNGIISDQELLPRRNSLILKPKPDPAQQTDSQNSDTEQYFREWFSKPANLHGVILPRVSGTHIKLWKLCYFRWVPEAQISLGGSITAFHKLSLLADEVDVLSRMLRQQRSGPLEACYGELGQSRMYFNASGPHHTDTSGTPEFLSSSFPFSPVGNLCRRSILGTPLSKFLSGAKIWLSTETLANED

SEQ ID NO: 54631 - protein, 86 aa, Homo sapiens
  Payload ID: 10787
  Gene Symbol: MTMR10
  Gene Name: myotubularin related protein 10
  ENSP ID: ENSP00000455869
  MOD_RES (1)..(1): Any amino acid
XLIIYCKDFRIVRFRFDESGPESAKKQTKLMEFPQEMEEEEEEEVMELVVAAARKLHSLKLTRIGTEKSRGQVLPGGEFVLLTRVT

SEQ ID NO: 54632 - protein, 50 aa, Homo sapiens
  Payload ID: 10787
  Gene Symbol: MTMR10
  Gene Name: myotubularin related protein 10
  ENSP ID: ENSP00000455903
MFSLKPPKPTFRSYLLPPPQTDDKINSEPKIKKLEPVLLPEIPLQKPSSW

SEQ ID NO: 54633 - protein, 451 aa, Homo sapiens
  Payload ID: 10787
  Gene Symbol: MTMR10
  Gene Name: myotubularin related protein 10
  Uniprot ID: Q9NXD2
  ENSP ID: ENSP00000457390
MPLQKFHYRNLLLGEHDVPLTCIEQIVTVNDHKRKQKVLGPNQKLKFNPTELIIYCKDFRIVRFRFDESGPESAKKVCLAIAHYSQPTDLQLLFAFEYVGKKYHNSANKINGIPSGDGGGGGGGGNGAGGGSSQKTPLFETYSDWDREIKRTGASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTVSRIKSCTKQDYFPSRV

SEQ ID NO: 54634 - protein, 190 aa, Homo sapiens
  Payload ID: 10787
  Gene Symbol: MTMR10
  Gene Name: myotubularin related protein 10
  ENSP ID: ENSP00000457781
MFSLKPPKPTFRSYLLPPPQTDDKINSEPKIKKLEPVLLPGEIVVNEVNFVRKCIATDTSQYDLWGKLICSNFKISFITDDPMPLQKFHYRNLLLGEHDVPLTCIEQIVTVNDHKRKQKVLGPNQKLKFNPTELIIYCKDFRIVRFRFDESGPESAKKVCLAIAHYSQPTDLQLLFAFEYVGKKYHNSEA

SEQ ID NO: 54635 - protein, 303 aa, Homo sapiens
  Payload ID: 10787
  Gene Symbol: MTMR10
  Gene Name: myotubularin related protein 10
  ENSP ID: ENSP00000457873
ASGWRVCSINEGYMISTCLPEYIVVPSSLADQDLKIFSHSFVGRRMPLWCWSHSNGSALVRMALIKDVLQQRKIDQRICNAITKSHPQRSDVYKSDLDKTLPNIQEVQAAFVKLKQLCVNEPFEETEEKWLSSLENTRWLEYVRAFLKHSAELVYMLESKHLSVVLQEEEGRDLSCCVASLVQVMLDPYFRTITGFQSLIQKEWVMAGYQFLDRCNHLKRSEKESPLFLLFLDATWQLLEQYPAAFEFSETYLAVLYDSTRISLFGTFLFNSPHQRVKQSTDKKLYKTRLFSFTSLKFLVTIH

SEQ ID NO: 54636 - protein, 218 aa, Homo sapiens
  Payload ID: 10787
  Gene Symbol: MTMR10
  Gene Name: myotubularin related protein 10
  Uniprot ID: Q9NXD2
  ENSP ID: ENSP00000457903
MFSLKPPKPTFRSYLLPPPQTDDKINSEPKIKKLEPVLLPGEIVVNEVNFVRKCIATDTSQYDLWGKLICSNFKISFITDDPMPLQKFHYRNLLLGEHDVPLTCIEQIVTVNDHKRKQKVLGPNQKLKFNPTELIIYCKDFRIVRFRFDESGPESAKKQTKLMEFPQEMEEEEEEEVMELVVAAARKLHSLKLTRIGTEKSRGQVLPGGEFVLLTRVT

SEQ ID NO: 54637 - protein, 777 aa, Homo sapiens; identical to SEQ ID NO: 54630
  Payload ID: 10787
  Gene Symbol: MTMR10
  Gene Name: myotubularin related protein 10
  Uniprot ID: Q9NXD2
  ENSP ID: ENSP00000484437

SEQ ID NO: 54638 - protein, 50 aa, Homo sapiens; identical to SEQ ID NO: 54632
  Payload ID: 10787
  Gene Symbol: MTMR10
  Gene Name: myotubularin related protein 10
  ENSP ID: ENSP00000486566

SEQ ID NO: 54639 - protein, 640 aa, Homo sapiens
  Payload ID: 10788
  Gene Symbol: MTMR11
  Gene Name: myotubularin related protein 11
  Uniprot ID: A4FU01
  ENSP ID: ENSP00000358136
MPPRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATSLPRYFWVPNRILDSEVRRAFGHFHQGRGPRLSWHHPGGSDLLRCGGFYTASDPNKEDIRAVELMLQAGHSDVVLVDTMDELPSLADVQLAHLRLRALCLPDSSVAEDKWLSALEGTRWLDYVRACLRKASDISVLVTSRVRSVILQERGDRDLNGLLSSLVQLLSAPEARTLFGFQSLVQREWVAAGHPFLTRLGGTGASEEAPVFLLFLDCVWQLLQQFPADFEFSEFFLLALHDSVRVPDTLTFLRNTPWERGKQSGQLNSYTQVYTPGYSQPPAGNSFNLQLSVWDWDLRYSNAQILQFQNPGYDPEHCPDSWLPRPQPSFMVPGPPSSVWLFSRGALTPLNQLCPWRDSPSLLAVSSRWLPRPAISSESLADQEWGLPSHWGACPLPPGLLLPGYLGPQIRLWRRCYLRGRPEVQMGLSAPTISGLQDELSHLQELLRKWTPRISPEDHSKKRDPHTILNPTEIAGILKGQSHPFWITRC

SEQ ID NO: 54640 - protein, 709 aa, Homo sapiens
  Payload ID: 10788
  Gene Symbol: MTMR11
  Gene Name: myotubularin related protein 11
  Uniprot ID: A4FU01
  ENSP ID: ENSP00000391668
MWWGGRGQSFNIAPQKEEPEMGSVQENRMPEPRSRQPSSCLASRCLPGEQILAWAPGVRKGLEPELSGTLICTNFRVTFQPCGWQWNQDTPLNSEYDFALVNIGRLEAVSGLSRVQLLRPGSLHKFIPEEILIHGRDFRLLRVGFEAGGLEPQAFQVTMAIVQARAQSNQAQQYSGITLSKAGQGSGSRKPPIPLMETAEDWETERKKQAARGWRVSTVNERFDVATSLPRYFWVPNRILDSEVRRAFGHFHQGRGPRLSWHHPGGSDLLRCGGFYTASDPNKEDIRAVELMLQAGHSDVVLVDTMDELPSLADVQLAHLRLRALCLPDSSVAEDKWLSALEGTRWLDYVRACLRKASDISVLVTSRVRSVILQERGDRDLNGLLSSLVQLLSAPEARTLFGFQSLVQREWVAAGHPFLTRLGGTGASEEAPVFLLFLDCVWQLLQQFPADFEFSEFFLLALHDSVRVPDTLTFLRNTPWERGKQSGQLNSYTQVYTPGYSQPPAGNSFNLQLSVWDWDLRYSNAQILQFQNPGYDPEHCPDSWLPRPQPSFMVPGPPSSVWLFSRGALTPLNQLCPWRDSPSLLAVSSRWLPRPAISSESLADQEWGLPSHWGACPLPPGLLLPGYLGPQIRLWRRCYLRGRPEVQMGLSAPTISGLQDELSHLQELLRKWTPRISPEDHSKKRDPHTILNPTEIAGILKGRAEGDLG

SEQ ID NO: 54641 - protein, 637 aa, Homo sapiens
  Payload ID: 10789
  Gene Symbol: MTMR12
  Gene Name: myotubularin related protein 12
  Uniprot ID: Q9C0I1
  ENSP ID: ENSP00000264934
MLGKGVVGGGGGTKAPKPSFVSYVRPEEIHTNEKEVTEKEVTLHLLPGEQLLCEASTVLKYVQEDSCQHGVYGRLVCTDFKIAFLGDDESALDNDETQFKNKVIGENDITLHCVDQIYGVFDEKKKTLFGQLKKYPEKLIIHCKDLRVFQFCLRYTKEEEVKRIVSGIIHHTQAPKLLKRLFLFSYATAAQNNTVTDPKNHTVMFDTLKDWCWELERTKGNMKYKAVSVNEGYKVCERLPAYFVVPTPLPEENVQRFQGHGIPIWCWSCHNGSALLKMSALPKEQDDGILQIQKSFLDGIYKTIHRPPYEIVKTEDLSSNFLSLQEIQTAYSKFKQLFLIDNSTEFWDTDIKWFSLLESSSWLDIIRRCLKKAIEITECMEAQNMNVLLLEENASDLCCLISSLVQLMMDPHCRTRIGFQSLIQKEWVMGGHCFLDRCNHLRQNDKEEHQRQLSLPLTQSKSSPKRGFFREETDHLIKNLLGKRISKLINSSDELQDNFREFYDSWHSKSTDYHGLLLPHIEGPEIKVWAQRYLRWIPEAQILGGGQVATLSKLLEMMEEVQSLQEKIDERHHSQQAPQAEAPCLLRNSARLSSLFPFALLQRHSSKPVLPTSGWKALGDEDDLAKREDEFVDLGDV

SEQ ID NO: 54642 - protein, 693 aa, Homo sapiens
  Payload ID: 10789
  Gene Symbol: MTMR12
  Gene Name: myotubularin related protein 12
  Uniprot ID: Q9C0I1
  ENSP ID: ENSP00000280285
MLGKGVVGGGGGTKAPKPSFVSYVRPEEIHTNEKEVTEKEVTLHLLPGEQLLCEASTVLKYVQEDSCQHGVYGRLVCTDFKIAFLGDDESALDNDETQFKNKVIGENDITLHCVDQIYGVFDEKKKTLFGQLKKYPEKLIIHCKDLRVFQFCLRYTKEEEVKRIVSGIIHHTQAPKLLKRLFLFSYATAAQNNTVTDPKNHTVMFDTLKDWCWELERTKGNMKYKAVSVNEGYKVCERLPAYFVVPTPLPEENVQRFQGHGIPIWCWSCHNGSALLKMSALPKEQDDGILQIQKSFLDGIYKTIHRPPYEIVKTEDLSSNFLSLQEIQTAYSKFKQLFLIDNSTEFWDTDIKWFSLLESSSWLDIIRRCLKKAIEITECMEAQNMNVLLLEENASDLCCLISSLVQLMMDPHCRTRIGFQSLIQKEWVMGGHCFLDRCNHLRQNDKEEVPVFLLFLDCVWQLVHQHPPAFEFTETYLTVLSDSLYIPIFSTFFFNSPHQKDTNMHQRQLSLPLTQSKSSPKRGFFREETDHLIKNLLGKRISKLINSSDELQDNFREFYDSWHSKSTDYHGLLLPHIEGPEIKVWAQRYLRWIPEAQILGGGQVATLSKLLEMMEEVQSLQEKIDERHHSQQAPQAEAPCLLRNSARLSSLFPFALLQRHSSKPVLPTSGWKALGDEDDLAKREDEFVDLGDV

SEQ ID NO: 54643 - protein, 747 aa, Homo sapiens
  Payload ID: 10789
  Gene Symbol: MTMR12
  Gene Name: myotubularin related protein 12
  Uniprot ID: Q9C0I1
  ENSP ID: ENSP00000371577
MLGKGVVGGGGGTKAPKPSFVSYVRPEEIHTNEKEVTEKEVTLHLLPGEQLLCEASTVLKYVQEDSCQHGVYGRLVCTDFKIAFLGDDESALDNDETQFKNKVIGENDITLHCVDQIYGVFDEKKKTLFGQLKKYPEKLIIHCKDLRVFQFCLRYTKEEEVKRIVSGIIHHTQAPKLLKRLFLFSYATAAQNNTVTDPKNHTVMFDTLKDWCWELERTKGNMKYKAVSVNEGYKVCERLPAYFVVPTPLPEENVQRFQGHGIPIWCWSCHNGSALLKMSALPKEQDDGILQIQKSFLDGIYKTIHRPPYEIVKTEDLSSNFLSLQEIQTAYSKFKQLFLIDNSTEFWDTDIKWFSLLESSSWLDIIRRCLKKAIEITECMEAQNMNVLLLEENASDLCCLISSLVQLMMDPHCRTRIGFQSLIQKEWVMGGHCFLDRCNHLRQNDKEEVPVFLLFLDCVWQLVHQHPPAFEFTETYLTVLSDSLYIPIFSTFFFNSPHQKDTNMGREGQDTQSKPLNLLTVWDWSVQFEPKAQTLLKNPLYVEKPKLDKGQRKGMRFKHQRQLSLPLTQSKSSPKRGFFREETDHLIKNLLGKRISKLINSSDELQDNFREFYDSWHSKSTDYHGLLLPHIEGPEIKVWAQRYLRWIPEAQILGGGQVATLSKLLEMMEEVQSLQEKIDERHHSQQAPQAEAPCLLRNSARLSSLFPFALLQRHSSKPVLPTSGWKALGDEDDLAKREDEFVDLGDV

SEQ ID NO: 54644 - protein, 38 aa, Homo sapiens
  Payload ID: 10789
  Gene Symbol: MTMR12
  Gene Name: myotubularin related protein 12
  ENSP ID: ENSP00000426028
MLGKGVVGGGGGTKAPKPSFVSYVRPEVNSCFVKPAQY

SEQ ID NO: 54645 - protein, 39 aa, Homo sapiens
  Payload ID: 10789
  Gene Symbol: MTMR12
  Gene Name: myotubularin related protein 12
  ENSP ID: ENSP00000426912
MLGKGVVGGGGGTKAPKPSFVSYVRPEVLLCCPDWNAVV

SEQ ID NO: 54646 - protein, 650 aa, Homo sapiens
  Payload ID: 10790
  Gene Symbol: MTMR14
  Gene Name: myotubularin related protein 14
  Uniprot ID: Q8NCE2
  ENSP ID: ENSP00000296003
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRSVDHPLPGSSLSTDYGSWQMVTGCGSIQERAVLHTDSSLPFSFPDELPNSCLLAALSDRETRLQEVRSAFLAAYSSTVGLRAVAPSPSGAIGGLLEQFARGVGLRSISSNAL

SEQ ID NO: 54647 - protein, 598 aa, Homo sapiens
  Payload ID: 10790
  Gene Symbol: MTMR14
  Gene Name: myotubularin related protein 14
  Uniprot ID: Q8NCE2
  ENSP ID: ENSP00000323462
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRLAALSDRETRLQEVRSAFLAAYSSTVGLRAVAPSPSGAIGGLLEQFARGVGLRSISSNAL

SEQ ID NO: 54648 - protein, 538 aa, Homo sapiens
  Payload ID: 10790
  Gene Symbol: MTMR14
  Gene Name: myotubularin related protein 14
  Uniprot ID: Q8NCE2
  ENSP ID: ENSP00000334070
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWLAALSDRETRLQEVRSAFLAAYSSTVGLRAVAPSPSGAIGGLLEQFARGVGLRSISSNAL

SEQ ID NO: 54649 - protein, 154 aa, Homo sapiens
  Payload ID: 10790
  Gene Symbol: MTMR14
  Gene Name: myotubularin related protein 14
  ENSP ID: ENSP00000388746
MALLILLLVPLLLPDSGSEAYSGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDR

SEQ ID NO: 54650 - protein, 188 aa, Homo sapiens
  Payload ID: 10790
  Gene Symbol: MTMR14
  Gene Name: myotubularin related protein 14
  ENSP ID: ENSP00000392690
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKGVQMMPGQMWRTSRRRTVLFEVVTRIFLIRSEAMTSSCFDTCQSNTSVT

SEQ ID NO: 54651 - protein, 60 aa, Homo sapiens
  Payload ID: 10790
  Gene Symbol: MTMR14
  Gene Name: myotubularin related protein 14
  ENSP ID: ENSP00000392935
MDAQATTIFSQGVQMMPGQMWRTSRRRTVLFEVVTRIFLIRSEAMTSSCFDTCQSNTSVT

SEQ ID NO: 54652 - protein, 292 aa, Homo sapiens
  Payload ID: 10790
  Gene Symbol: MTMR14
  Gene Name: myotubularin related protein 14
  ENSP ID: ENSP00000401993
MAGARAAAAAASAGSSASSGNQPPQELGLGELLEEFSRTQYRAKDGSGTGGSKCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWLAALSDRETRLQEVRSAFLAAYSSTVGLRAVAPSPSGAIGGLLEQFARGVGLRSISSNAL

SEQ ID NO: 54653 - protein, 71 aa, Homo sapiens
  Payload ID: 10790
  Gene Symbol: MTMR14
  Gene Name: myotubularin related protein 14
  ENSP ID: ENSP00000408813
MAGARAAAAAASAGSSASSGNQPPQELGLGELLEEFSRTQYRAKDGSGTGGSKSSYRQTWRASCQLRPSPP

SEQ ID NO: 54654 - protein, 187 aa, Homo sapiens
  Payload ID: 10790
  Gene Symbol: MTMR14
  Gene Name: myotubularin related protein 14
  ENSP ID: ENSP00000410761
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTSGDTHLFDKVRGYDIKLLRYLSVKYICDLMVENKKVKFGMNVTSSEKVDKAQRYADFTLLSIPYPVLGSGATNTKLPEAAAFLS

SEQ ID NO: 54655 - protein, 36 aa, Homo sapiens
  Payload ID: 10790
  Gene Symbol: MTMR14
  Gene Name: myotubularin related protein 14
  ENSP ID: ENSP00000411417
MSHCAWPETELELDVGEPVKEPLADLTRKGLRVPYR

SEQ ID NO: 54656 - protein, 158 aa, Homo sapiens
  Payload ID: 10790
  Gene Symbol: MTMR14
  Gene Name: myotubularin related protein 14
  ENSP ID: ENSP00000412644
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQGVQMMPGQMWRTSRRRTVLFEVVTRIFLIRSEAMTSSCFDTCQSNTSVT

SEQ ID NO: 54657 - protein, 520 aa, Homo sapiens
  Payload ID: 10790
  Gene Symbol: MTMR14
  Gene Name: myotubularin related protein 14
  ENSP ID: ENSP00000478236
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYGRGAGPSRSANSGSLEEEPLILSTECPLEPATTLRGPLAFPAGAGGSQVFQLLFLKPF

SEQ ID NO: 54658 - protein, 571 aa, Homo sapiens
  Payload ID: 10791
  Gene Symbol: MTMR2
  Gene Name: myotubularin related protein 2
  Uniprot ID: Q13614
  ENSP ID: ENSP00000343737
MEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKIFIFDARPSVNAVANKAKGGGYESEDAYQNAELVFLDIHNIHVMRESLRKLKEIVYPNIEETHWLSNLESTHWLEHIKLILAGALRIADKVESGKTSVVVHCSDGWDRTAQLTSLAMLMLDGYYRTIRGFEVLVEKEWLSFGHRFQLRVGHGDKNHADADRSPVFLQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQEPIHNRYKELLAKRAELQKKVEELQREISNRSTSSSERASSPAQCVTPVQTVV

SEQ ID NO: 54659 - protein, 643 aa, Homo sapiens
  Payload ID: 10791
  Gene Symbol: MTMR2
  Gene Name: myotubularin related protein 2
  Uniprot ID: Q13614
  ENSP ID: ENSP00000345752
MEKSSSCESLGSQPAAARPPSVDSLSSASTSHSENSVHTKSASVVSSDSISTSADNFSPDLRVLRESNKLAEMEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKIFIFDARPSVNAVANKAKGGGYESEDAYQNAELVFLDIHNIHVMRESLRKLKEIVYPNIEETHWLSNLESTHWLEHIKLILAGALRIADKVESGKTSVVVHCSDGWDRTAQLTSLAMLMLDGYYRTIRGFEVLVEKEWLSFGHRFQLRVGHGDKNHADADRSPVFLQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQEPIHNRYKELLAKRAELQKKVEELQREISNRSTSSSERASSPAQCVTPVQTVV

SEQ ID NO: 54660 - protein, 571 aa, Homo sapiens; identical to SEQ ID NO: 54658
  Payload ID: 10791
  Gene Symbol: MTMR2
  Gene Name: myotubularin related protein 2
  Uniprot ID: Q13614
  ENSP ID: ENSP00000376915

SEQ ID NO: 54661 - protein, 571 aa, Homo sapiens; identical to SEQ ID NO: 54658
  Payload ID: 10791
  Gene Symbol: MTMR2
  Gene Name: myotubularin related protein 2
  Uniprot ID: Q13614
  ENSP ID: ENSP00000386882

SEQ ID NO: 54662 - protein, 556 aa, Homo sapiens
  Payload ID: 10791
  Gene Symbol: MTMR2
  Gene Name: myotubularin related protein 2
  ENSP ID: ENSP00000396020
MEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKIFIFDARPSVNAVANKAKGGGYESEDAYQNAELVFLDIHNIHVMRESLRKLKEIVYPNIEETHWLSNLESTHWLEHIKLILAGALRIADKVESGKTSVVVHCSDGWDRTAQLTSLAMLMLDGYYRTIRGFEVLVEKEWLSFGHRFQLRVGHGDKNHADADRSPVFLQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQEPIHNRYKELLAKRAELQKKVEELQREISNRSTSSSER

SEQ ID NO: 54663 - protein, 1161 aa, Homo sapiens
  Payload ID: 10792
  Gene Symbol: MTMR3
  Gene Name: myotubularin related protein 3
  Uniprot ID: Q13615
  ENSP ID: ENSP00000307271
MDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVMTRWLPDHLAAHCYACDSAFWLASRKHHCRNCGNVFCSSCCNQKVPVPSQQLFEPSRVCKSCYSSLHPTSSSIDLELDKPIAATSN

SEQ ID NO: 54664 - protein, 1062 aa, Homo sapiens
  Payload ID: 10792
  Gene Symbol: MTMR3
  Gene Name: myotubularin related protein 3
  ENSP ID: ENSP00000318070
MEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVTSIPDSESNLDQNCLSRCSTEIFSEASWEQVDKQDTEMTRWLPDHLAAHCYACDSAFWLASRKHHCRNCGNVFCSSCCNQKVPVPSQQLFEPSRVCKSCYSSLHPTSSSIDLELDKPIAATSN

SEQ ID NO: 54665 - protein, 1170 aa, Homo sapiens
  Payload ID: 10792
  Gene Symbol: MTMR3
  Gene Name: myotubularin related protein 3
  Uniprot ID: Q13615
  ENSP ID: ENSP00000331649
MDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVMTRWLPDHLAAHCYACDSAFWLASRKHHCRDTDRVDQTWNCGNVFCSSCCNQKVPVPSQQLFEPSRVCKSCYSSLHPTSSSIDLELDKPIAATSN

SEQ ID NO: 54666 - protein, 1170 aa, Homo sapiens; identical to SEQ ID NO: 54665
  Payload ID: 10792
  Gene Symbol: MTMR3
  Gene Name: myotubularin related protein 3
  Uniprot ID: Q13615
  ENSP ID: ENSP00000384077

SEQ ID NO: 54667 - protein, 1198 aa, Homo sapiens
  Payload ID: 10792
  Gene Symbol: MTMR3
  Gene Name: myotubularin related protein 3
  Uniprot ID: Q13615
  ENSP ID: ENSP00000384651
MDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVTSIPDSESNLDQNCLSRCSTEIFSEASWEQVDKQDTEMTRWLPDHLAAHCYACDSAFWLASRKHHCRNCGNVFCSSCCNQKVPVPSQQLFEPSRVCKSCYSSLHPTSSSIDLELDKPIAATSN

SEQ ID NO: 54668 - protein, 139 aa, Homo sapiens
  Payload ID: 10792
  Gene Symbol: MTMR3
  Gene Name: myotubularin related protein 3
  ENSP ID: ENSP00000409063
MDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEV

SEQ ID NO: 54669 - protein, 1195 aa, Homo sapiens
  Payload ID: 10793
  Gene Symbol: MTMR4
  Gene Name: myotubularin related protein 4
  Uniprot ID: Q9NYA4
  ENSP ID: ENSP00000325285
MGEEGPPSLEYIQAKDLFPPKELVKEEENLQVPFTVLQGEGVEFLGRAADALIAISNYRLHIKFKDSVINVPLRMIDSVESRDMFQLHISCKDSKVVRCHFSTFKQCQEWLSRLSRATARPAKPEDLFAFAYHAWCLGLTEEDQHTHLCQPGEHIRCRQEAELARMGFDLQNVWRVSHINSNYKLCPSYPQKLLVPVWITDKELENVASFRSWKRIPVVVYRHLRNGAAIARCSQPEISWWGWRNADDEYLVTSIAKACALDPGTRATGGSLSTGNNDTSEACDADFDSSLTACSGVESTAAPQKLLILDARSYTAAVANRAKGGGCECEEYYPNCEVVFMGMANIHAIRNSFQYLRAVCSQMPDPSNWLSALESTKWLQHLSVMLKAAVLVANTVDREGRPVLVHCSDGWDRTPQIVALAKILLDPYYRTLEGFQVLVESDWLDFGHKFGDRCGHQENVEDQNEQCPVFLQWLDSVHQLLKQFPCLFEFNEAFLVKLVQHTYSCLYGTFLANNPCEREKRNIYKRTCSVWALLRAGNKNFHNFLYTPSSDMVLHPVCHVRALHLWTAVYLPASSPCTLGEENMDLYLSPVAQSQEFSGRSLDRLPKTRSMDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAVSALSKVISNKCDGVCNFPESSQNSPTGTPQQAQPDSMLGVPSKCVLDHSLSTVCNPPSAACQTPLDPSTDFLNQDPSGSVASISHQEQLSSVPDLTHGEEDIGKRGNNRNGQLLENPRFGKMPLELVRKPISQSQISEFSFLGSNWDSFQGMVTSFPSGEATPRRLLSYGCCSKRPNSKQMRATGPCFGGQWAQREGVKSPVCSSHSNGHCTGPGGKNQMWLSSHPKQVSSTKPVPLNCPSPVPPLYLDDDGLPFPTDVIQHRLRQIEAGYKQEVEQLRRQVRELQMRLDIRHCCAPPAEPPMDYEDDFTCLKESDGSDTEDFGSDHSEDCLSEASWEPVDKKETEVTRWVPDHMASHCYNCDCEFWLAKRRHHCRNCGNVFCAGCCHLKLPIPDQQLYDPVLVCNSCYEHIQVSRARELMSQQLKKPIATASS

SEQ ID NO: 54670 - protein, 112 aa, Homo sapiens
  Payload ID: 10793
  Gene Symbol: MTMR4
  Gene Name: myotubularin related protein 4
  ENSP ID: ENSP00000462869
MSLTARVSCSMLSCFGEEGPPSLEYIQAKDLFPPKELVKEEENLQVPFTVLQGEGVEFLGRAADALIAISNYRLHIKFKDSVINVPLRMIDSVESRDMFQLHISCKDSKVVR

SEQ ID NO: 54671 - protein, 95 aa, Homo sapiens
  Payload ID: 10793
  Gene Symbol: MTMR4
  Gene Name: myotubularin related protein 4
  ENSP ID: ENSP00000463259
MGRGMGEEGPPSLEYIQAKDLFPPKELVKEEENLQVPFTVLQGEGVEFLGRAADALIAISNYRLHIKFKDSVINVPLRMIDSVESRDMFQLHISC

SEQ ID NO: 54672 - protein, 197 aa, Homo sapiens
  Payload ID: 10793
  Gene Symbol: MTMR4
  Gene Name: myotubularin related protein 4
  ENSP ID: ENSP00000463479
MSLTARVSCSMLSCFGEEGPPSLEYIQAKDLFPPKELVKEEENLQVPFTVLQGEGVEFLGRAADALIAISNYRLHIKFKDSVINVPLRMIDSVESRDMFQLHISCKDSKVVRCHFSTFKQCQEWLSRLSRATARPAKPEDLFAFAYHAWCLGLTEEDQHTHLCQPGEHIRCRQEAELARMGFDLQNVWRVSHINSNY

SEQ ID NO: 54673 - protein, 1138 aa, Homo sapiens
  Payload ID: 10793
  Gene Symbol: MTMR4
  Gene Name: myotubularin related protein 4
  ENSP ID: ENSP00000464067
MGEEGPPSLEYIQAKDLFPPKELVKEEENLQVPFTVLQGEGVEFLGRAADALIAISNYRLHIKFKDSVINVPLRMIDSVESRDMFQLHISCKDSKVVRCHFSTFKQCQEWLSRLSRATARPAKPEDLFAFAYHAWCLGLTEEDQHTHLCQPGEHIRCRQEAELARMGFDLQNVWRVSHINSNYKLCPSYPQKLLVPVWITDKELENVASFRSWKRIPVVVYRHLRNGAAIARCSQPEISWWGWRNADDEYLVTSIAKACALDPGTRATGGSLSTGNNDTSEACDADFDSSLTACSGVESTAAPQKLLILDARSYTAAVANRAKGGGCECEEYYPNCEVVFMGMANIHAIRNSFQYLRAVCSQMPDPSNWLSALESTKWLQHLSVMLKAAVLVANTVDREGRPVLVHCSDGWDRTPQIVALAKILLDPYYRTLEGFQVLVESDWLDFGHKFGDRCGHQENVEDQNEQCPVFLQWLDSVHQLLKQFPCLFEFNEAFLVLHPVCHVRALHLWTAVYLPASSPCTLGEENMDLYLSPVAQSQEFSGRSLDRLPKTRSMDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAVSALSKVISNKCDGVCNFPESSQNSPTGTPQQAQPDSMLGVPSKCVLDHSLSTVCNPPSAACQTPLDPSTDFLNQDPSGSVASISHQEQLSSVPDLTHGEEDIGKRGNNRNGQLLENPRFGKMPLELVRKPISQSQISEFSFLGSNWDSFQGMVTSFPSGEATPRRLLSYGCCSKRPNSKQMRATGPCFGGQWAQREGVKSPVCSSHSNGHCTGPGGKNQMWLSSHPKQVSSTKPVPLNCPSPVPPLYLDDDGLPFPTDVIQHRLRQIEAGYKQEVEQLRRQVRELQMRLDIRHCCAPPAEPPMDYEDDFTCLKESDGSDTEDFGSDHSEDCLSEASWEPVDKKETEVTRWVPDHMASHCYNCDCEFWLAKRRHHCRNCGNVFCAGCCHLKLPIPDQQLYDPVLVCNSCYEHIQVSRARELMSQQLKKPIATASS

SEQ ID NO: 54674 - protein, 98 aa, Homo sapiens
  Payload ID: 10793
  Gene Symbol: MTMR4
  Gene Name: myotubularin related protein 4
  ENSP ID: ENSP00000464247
MGEEGPPSLEYIQAKDLFPPKELVKEEENLQVPFTVLQGEGVEFLGRAADALIAISNYRLHIKFKDSVINVPLRMIDSVESRDMFQLHISCKDSKVVR

SEQ ID NO: 54675 - protein, 16 aa, Homo sapiens
  Payload ID: 10793
  Gene Symbol: MTMR4
  Gene Name: myotubularin related protein 4
  ENSP ID: ENSP00000464588
MIDSVESRDMFQLHIS

SEQ ID NO: 54676 - protein, 621 aa, Homo sapiens
  Payload ID: 10794
  Gene Symbol: MTMR6
  Gene Name: myotubularin related protein 6
  Uniprot ID: Q9Y217
  ENSP ID: ENSP00000371221
MEHIRTTKVEQVKLLDRFSTSNKSLTGTLYLTATHLLFIDSHQKETWILHHHIASVEKLALTTSGCPLVIQCKNFRTVHFIVPRERDCHDIYNSLLQLSKQAKYEDLYAFSYNPKQNDSERLQGWQLIDLAEEYKRMGVPNSHWQLSDANRDYKICETYPRELYVPRIASKPIIVGSSKFRSKGRFPVLSYYHQDKEAAICRCSQPLSGFSARCLEDEHLLQAISKANPVNRYMYVMDTRPKLNAMANRAAGKGYENEDNYSNIRFQFVGIENIHVMRSSLQKLLEVNGTKGLSVNDFYSGLESSGWLRHIKAVMDAAIFLAKAITVENASVLVHCSDGWDRTSQVCSLGSLLLDSYYRTIKGFMVLIEKDWISFGHKFSERCGQLDGDPKEVSPVFTQFLECVWHLTEQFPQAFEFSEAFLLQIHEHIHSCQFGNFLGNCQKEREELKLKEKTYSLWPFLLEDQKKYLNPLYSSESHRFTVLEPNTVSFNFKFWRNMYHQFDRTLHPRQSVFNIIMNMNEQNKQLEKDIKDLESKIKQRKNKQTDGILTKELLHSVHPESPNLKTSLCFKEQTLLPVNDALRTIEGSSPADNRYSEYAEEFSKSEPAVVSLEYGVARMTC

SEQ ID NO: 54677 - protein, 660 aa, Homo sapiens
  Payload ID: 10795
  Gene Symbol: MTMR7
  Gene Name: myotubularin related protein 7
  Uniprot ID: Q9Y216
  ENSP ID: ENSP00000180173
MEHIRTPKVENVRLVDRVSPKKAALGTLYLTATHVIFVENSPDPRKETWILHSQISTIEKQATTATGCPLLIRCKNFQIIQLIIPQERDCHDVYISLIRLARPVKYEELYCFSFNPMLDKEEREQGWVLIDLSEEYTRMGLPNHYWQLSDVNRDYRVCDSYPTELYVPKSATAHIIVGSSKFRSRRRFPVLSYYYKDNHASICRSSQPLSGFSARCLEDEQMLQAIRKANPGSDFVYVVDTRPKLNAMANRAAGKGYENEDNYSNIKFQFIGIENIHVMRNSLQKMLEVCELKSPSMSDFLWGLENSGWLRHIKAIMDAGIFIAKAVSEEGASVLVHCSDGWDRTAQVCSVASLLLDPHYRTLKGFMVLIEKDWISFGHKFNHRYGNLDGDPKEISPVIDQFIECVWQLMEQFPCAFEFNERFLIHIQHHIYSCQFGNFLCNSQKERRELKIQERTYSLWAHLWKNRADYLNPLFRADHSQTQGTLHLPTTPCNFMYKFWSGMYNRFEKGMQPRQSVTDYLMAVKEETQQLEEELEALEERLEKIQKVQLNCTKVKSKQSEPSKHSGFSTSDNSIANTPQDYSGNMKSFPSRSPSQGDEDSALILTQDNLKSSDPDLSANSDQESGVEDLSCRSPSGGEHAPSEDSGKDRDSDEAVFLTA

SEQ ID NO: 54678 - protein, 555 aa, Homo sapiens
  Payload ID: 10795
  Gene Symbol: MTMR7
  Gene Name: myotubularin related protein 7
  Uniprot ID: Q9Y216
  ENSP ID: ENSP00000429733
MEHIRTPKVENVRLVDRVSPKKAALGTLYLTATHVIFVENSPDPRKETWILHSQISTIEKQATTATGCPLLIRCKNFQIIQLIIPQERDCHDVYISLIRLARPVKYEELYCFSFNPMLDKEEREQGWVLIDLSEEYTRMGLPNHYWQLSDVNRDYRVCDSYPTELYVPKSATAHIIVGSSKFRSRRRFPVLSYYYKDNHASICRSSQPLSGFSARCLEDEQMLQAIRKANPGSDFVYVVDTRPKLNAMANRAAGKGYENEDNYSNIKFQFIGIENIHVMRNSLQKMLEVCELKSPSMSDFLWGLENSGWLRHIKAIMDAGIFIAKAVSEEGASVLVHCSDGWDRTAQVCSVASLLLDPHYRTLKGFMVLIEKDWISFGHKFNHRYGNLDGDPKEISPVIDQFIECVWQLMEQFPCAFEFNERFLIHIQHHIYSCQFGNFLCNSQKERRELKIQERTYSLWAHLWKNRADYLNPLFRADHSQTQGTLHLPTTPCNFMYKFWSGMYNRFEKGMQPRQSVTDYLMAVKEETQQLEEELEALEEVRHTCFVNLFSVLIS

SEQ ID NO: 54679 - protein, 105 aa, Homo sapiens
  Payload ID: 10795
  Gene Symbol: MTMR7
  Gene Name: myotubularin related protein 7
  ENSP ID: ENSP00000431000
MEHIRTPKVENVRLVDRVSPKKAALGTLYLTATHVIFVENSPDPRKETWILHSQISTIEKQATTATGCPLLIRCKNFQIIQLIIPQERDCHDVYISLIRLARPGL

SEQ ID NO: 54680 - protein, 704 aa, Homo sapiens
  Payload ID: 10796
  Gene Symbol: MTMR8
  Gene Name: myotubularin related protein 8
  Uniprot ID: Q96EF0
  ENSP ID: ENSP00000363985
MDHITVPKVENVKLVDRYVSKKPANGILYLTATHLIYVEASGAARKETWIALHHIATVEKLPITSLGCPLTLRCKNFRVAHFVLDSDLVCHEVYISLLKLSQPALPEDLYAFSYNPKSSKEMRESGWKLIDPISDFGRMGIPNRNWTITDANRNYEICSTYPPEIVVPKSVTLGTVVGSSKFRSKERVPVLSYLYKENNAAICRCSQPLSGFYTRCVDDELLLEAISQTNPGSQFMYVVDTRPKLNAMANRAAGKGYENEDNYANIRFRFMGIENIHVMRSSLQKLLEVCELKTPTMSEFLSGLESSGWLRHIKAIMDAGIFITKAVKVEKASVLVHCSDGWDRTAQVCSVASILLDPFYRTFKGLMILIEKEWISMGHKFSQRCGHLDGDSKEVSPIFTQFLDCIWQLMEQFPCAFEFNENFLLEIHDHVFSCQFGNFLGNCQKDREDLRVYEKTHSVWPFLVQRKPDFRNPLYKGFTMYGVLNPSTVPYNIQFWCGMYNRFDKGLQPKQSMLESLLEIKKQRAMLETDVHELEKKLKVRDEPPEEICTCSQLGNILSQHLGSPLTNPLGFMGINGDLNTLMENGTLSREGGLRAQMDQVKSQGADLHHNCCEIVGSLRAINISGDVGISEAMGISGDMCTFEATGFSKDLGICGAMDISEATGISGNLGISEARGFSGDMGILGDTGISKASTKEADYSKHQ

SEQ ID NO: 54681 - protein, 549 aa, Homo sapiens
  Payload ID: 10797
  Gene Symbol: MTMR9
  Gene Name: myotubularin related protein 9
  Uniprot ID: Q96QG7
  ENSP ID: ENSP00000221086
MEFAELIKTPRVDNVVLHRPFYPAVEGTLCLTGHHLILSSRQDNTEELWLLHSNIDAIDKRFVGSLGTIIIKCKDFRIIQLDIPGMEECLNIASSIEALSTLDSITLMYPFFYRPMFEVIEDGWHSFLPEQEFELYSSATSEWRLSYVNKEFAVCPSYPPIVTVPKSIDDEALRKVATFRHGGRFPVLSYYHKKNGMVIMRSGQPLTGTNGRRCKEDEKLINATLRAGKRGYIIDTRSLNVAQQTRAKGGGFEQEAHYPQWRRIHKSIERYHILQESLIKLVEACNDQTHNMDRWLSKLEASNWLTHIKEILTTACLAAQCIDREGASILIHGTEGTDSTLQVTSLAQIILEPRSRTIRGFEALIEREWLQAGHPFQQRCAQSAYCNTKQKWEAPVFLLFLDCVWQILRQFPCSFEFNENFLIMLFEHAYASQFGTFLGNNESERCKLKLQQKTMSLWSWVNQPSELSKFTNPLFEANNLVIWPSVAPQSLPLWEGIFLRWNRSSKYLDEAYEEMVNIIEYNKELQAKVNILRRQLAELETEDGMQESP

SEQ ID NO: 54682 - protein, 464 aa, Homo sapiens
  Payload ID: 10797
  Gene Symbol: MTMR9
  Gene Name: myotubularin related protein 9
  Uniprot ID: Q96QG7
  ENSP ID: ENSP00000433239
MEECLNIASSIEALSTLDSITLMYPFFYRPMFEVIEDGWHSFLPEQEFELYSSATSEWRLSYVNKEFAVCPSYPPIVTVPKSIDDEALRKVATFRHGGRFPVLSYYHKKNGMVIMRSGQPLTGTNGRRCKEDEKLINATLRAGKRGYIIDTRSLNVAQQTRAKGGGFEQEAHYPQWRRIHKSIERYHILQESLIKLVEACNDQTHNMDRWLSKLEASNWLTHIKEILTTACLAAQCIDREGASILIHGTEGTDSTLQVTSLAQIILEPRSRTIRGFEALIEREWLQAGHPFQQRCAQSAYCNTKQKWEAPVFLLFLDCVWQILRQFPCSFEFNENFLIMLFEHAYASQFGTFLGNNESERCKLKLQQKTMSLWSWVNQPSELSKFTNPLFEANNLVIWPSVAPQSLPLWEGIFLRWNRSSKYLDEAYEEMVNIIEYNKELQAKVNILRRQLAELETEDGMQESP

SEQ ID NO: 54683 - protein, 101 aa, Homo sapiens
  Payload ID: 10797
  Gene Symbol: MTMR9
  Gene Name: myotubularin related protein 9
  ENSP ID: ENSP00000436046
MEFAELIKTPRVDNVVLHRPFYPAVEGTLCLTGHHLILSSRQDNTEELWLLHSNIDAIDKRFVGSLGTIIIKCKDFRIIQLDIPGMEECLNIASSIENPSC

SEQ ID NO: 54684 - protein, 299 aa, Homo sapiens
  Payload ID: 10798
  Gene Symbol: MYOZ1
  Gene Name: myozenin 1
  Uniprot ID: Q9NP98
  ENSP ID: ENSP00000352272
MPLSGTPAPNKKRKSSKLIMELTGGGQESSGLNLGKKISVPRDVMLEELSLLTNRGSKMFKLRQMRVEKFIYENHPDVFSDSSMDHFQKFLPTVGGQLGTAGQGFSYSKSNGRGGSQAGGSGSAGQYGSDQQHHLGSGSGAGGTGGPAGQAGRGGAAGTAGVGETGSGDQAGGEGKHITVFKTYISPWERAMGVDPQQKMELGIDLLAYGAKAELPKYKSFNRTAMPYGGYEKASKRMTFQMPKFDLGPLLSEPLVLYNQNLSNRPSFNRTPIPWLSSGEPVDYNVDIGIPLDGETEEL

SEQ ID NO: 54685 - protein, 264 aa, Homo sapiens
  Payload ID: 10799
  Gene Symbol: MYOZ2
  Gene Name: myozenin 2
  Uniprot ID: Q9NPC6
  ENSP ID: ENSP00000306997
MLSHNTMMKQRKQQATAIMKEVHGNDVDGMDLGKKVSIPRDIMLEELSHLSNRGARLFKMRQRRSDKYTFENFQYQSRAQINHSIAMQNGKVDGSNLEGGSQQAPLTPPNTPDPRSPPNPDNIAPGYSGPLKEIPPEKFNTTAVPKYYQSPWEQAISNDPELLEALYPKLFKPEGKAELPDYRSFNRVATPFGGFEKASRMVKFKVPDFELLLLTDPRFMSFVNPLSGRRSFNRTPKGWISENIPIVITTEPTDDTTVPESEDL

SEQ ID NO: 54686 - protein, 251 aa, Homo sapiens
  Payload ID: 10800
  Gene Symbol: MYOZ3
  Gene Name: myozenin 3
  Uniprot ID: Q8TDC0
  ENSP ID: ENSP00000297130
MIPKEQKGPVMAAMGDLTEPVPTLDLGKKLSVPQDLMMEELSLRNNRGSLLFQKRQRRVQKFTFELAASQRAMLAGSARRKVTGTAESGTVANANGPEGPNYRSELHIFPASPGASLGGPEGAHPAAAPAGCVPSPSALAPGYAEPLKGVPPEKFNHTAISKGYRCPWQEFVSYRDYQSDGRSHTPSPNDYRNFNKTPVPFGGPLVGGTFPRPGTPFIPEPLSGLELLRLRPSFNRVAQGWVRNLPESEEL

SEQ ID NO: 54687 - protein, 251 aa, Homo sapiens; identical to SEQ ID NO: 54686
  Payload ID: 10800
  Gene Symbol: MYOZ3
  Gene Name: myozenin 3
  Uniprot ID: Q8TDC0
  ENSP ID: ENSP00000428815

SEQ ID NO: 54688 - protein, 159 aa, Homo sapiens
  Payload ID: 10800
  Gene Symbol: MYOZ3
  Gene Name: myozenin 3
  ENSP ID: ENSP00000429439
MGRGLLCWSNCGFPFPPSSPLTPIFPPPTASAEWGWGEVGLGAEGGRTEALPSPRAPRLCGAAEGRPAREVQPHRHLQGLPLPLAGVRQLPGLPERWPKSHPQPQRLPKFQQDPGAIWRTPRGGHFSQARHPLHPGAPQWLGTPPSQTQLQQSGPGLGP

SEQ ID NO: 54689 - protein, 104 aa, Homo sapiens
  Payload ID: 10800
  Gene Symbol: MYOZ3
  Gene Name: myozenin 3
  ENSP ID: ENSP00000430913
NANGPEGPNYRSELHIFPASPGASLGGPEGAHPAAAPAGCVPSPSALAPGYAEPLKGVPPEKFNHTAISKGYRCPWQEFVSYRDYQSDGRSHTPSPNDYRNFNK

SEQ ID NO: 54690 - protein, 87 aa, Homo sapiens
  Payload ID: 10800
  Gene Symbol: MYOZ3
  Gene Name: myozenin 3
  Uniprot ID: Q8TDC0
  ENSP ID: ENSP00000478375
MLREVGPGVYGGWGGESPLWPFLAVPTLDLGKKLSVPQDLMMEELSLRNNRGSLLFQKRQRRVQKFTFELAASQRAVSKPPLCSWGK

SEQ ID NO: 54691 - protein, 332 aa, Homo sapiens
  Payload ID: 10801
  Gene Symbol: MARCKS
  Gene Name: myristoylated alanine-rich protein kinase C substrate
  Uniprot ID: P29966
  ENSP ID: ENSP00000478061
MGAQFSKTAAKGEAAAERPGEAAVASSPSKANGQENGHVKVNGDASPAAAESGAKEELQANGSAPAADKEEPAAAGSGAASPSAAEKGEPAAAAAPEAGASPVEKEAPAEGEAAEPGSPTAAEGEAASAASSTSSPKAEDGATPSPSNETPKKKKKRFSFKKSFKLSGFSFKKNKKEAGEGGEAEAPAAEGGKDEAAGGAAAAAAEAGAASGEQAAAPGEEAAAGEEGAAGGDPQEAKPQEAAVAPEKPPASDETKAAEEPSKVEEKKAEEAGASAAACEAPSAAGPGAPPEQEAAPAEEPAAAAASSACAAPSQEAQPECSPEAPPAEAAE

SEQ ID NO: 54692 - protein, 330 aa, Homo sapiens
  Payload ID: 10801
  Gene Symbol: MARCKS
  Gene Name: myristoylated alanine-rich protein kinase C substrate
  ENSP ID: ENSP00000482673
MGAQFSKTAAKGEAAAERPGEAAVASSPSKANGQENGHVKVNGDASPAAAESGAKEELQANGSAPAADKEEPAAAGSGAASPSAAEKGEPAAAAAPEAGASPVEKEAPAEGEAAEPGSPTAAEGEAASAASSTSSPKAEDGATPSPSNETPKKKKKRFSFKKSFKLSGFSFKKNKKEAGEGGEAEAPAAEGGKDEAAGGAAAAAAEAGAASGEQAAAPGEEAAAGEEGAAGGDPQEAKPQEAAVAPEKPPASDETKAAEEPSKVEEKKAEEAGASAAACEAPSAAGPARPRSGGSPRGGARGRRSLVSAAPSQEAQPECSPEAPPAEAAE

SEQ ID NO: 54693 - protein, 191 aa, Homo sapiens
  Payload ID: 10802
  Gene Symbol: MEAF6
  Gene Name: MYST/Esa1-associated factor 6
  Uniprot ID: Q9HAF1
  ENSP ID: ENSP00000296214
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHRIDLKLNKKPRADY

SEQ ID NO: 54694 - protein, 192 aa, Homo sapiens
  Payload ID: 10802
  Gene Symbol: MEAF6
  Gene Name: MYST/Esa1-associated factor 6
  Uniprot ID: Q9HAF1
  ENSP ID: ENSP00000362164
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHRMNVSPKTGWHQLHL

SEQ ID NO: 54695 - protein, 169 aa, Homo sapiens
  Payload ID: 10802
  Gene Symbol: MEAF6
  Gene Name: MYST/Esa1-associated factor 6
  ENSP ID: ENSP00000362165
MSLFFISQETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHRIDLKLNKKPRADY

SEQ ID NO: 54696 - protein, 201 aa, Homo sapiens
  Payload ID: 10802
  Gene Symbol: MEAF6
  Gene Name: MYST/Esa1-associated factor 6
  Uniprot ID: Q9HAF1
  ENSP ID: ENSP00000362166
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHSPSGMFDYDFEIDLKLNKKPRADY

SEQ ID NO: 54697 - protein, 191 aa, Homo sapiens
  Payload ID: 10802
  Gene Symbol: MEAF6
  Gene Name: MYST/Esa1-associated factor 6
  Uniprot ID: Q9HAF1
  ENSP ID: ENSP00000394966
MAMHNKAAPPQIPDTRRELAELVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEDLDGSVQGVKPQKAASSTSSGSHHSSHKKRKNKNRHSPSGMFDYDFEYVY

SEQ ID NO: 54698 - protein, 220 aa, Homo sapiens
  Payload ID: 10803
  Gene Symbol: NAA10
  Gene Name: N(alpha)-acetyltransferase 10, NatA catalytic subunit
  Uniprot ID: P41227
  ENSP ID: ENSP00000359026
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKRISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 54699 - protein, 142 aa, Homo sapiens
  Payload ID: 10803
  Gene Symbol: NAA10
  Gene Name: N(alpha)-acetyltransferase 10, NatA catalytic subunit
  ENSP ID: ENSP00000359028
MNIRNARPEDLMNMQHCNLLCLPENYQMKYYFYHGLSWPQLSYIAEDENGKIVGEEDPDDVPHGHITSLAVKRSHRRLGLAQKLMDQASRAMIENFNAKYVSLHVRKRISEVEPKYYADGEDAYAMKRDLTQMADELRRHLE

SEQ ID NO: 54700 - protein, 169 aa, Homo sapiens
  Payload ID: 10803
  Gene Symbol: NAA10
  Gene Name: N(alpha)-acetyltransferase 10, NatA catalytic subunit
  ENSP ID: ENSP00000359032
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKSNRAALHLYSNTLNFQISEVEPKYYADGEDAYAMKRDLTQMADEPATGPGSLCLET

SEQ ID NO: 54701 - protein, 184 aa, Homo sapiens
  Payload ID: 10803
  Gene Symbol: NAA10
  Gene Name: N(alpha)-acetyltransferase 10, NatA catalytic subunit
  ENSP ID: ENSP00000377315
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKSNRAALHLYSNTLNFQISEVEPKYYADGEDAYAMKRDLTQMADERQGQAPFVWKLRPCLFAPASPWVPGGS

SEQ ID NO: 54702 - protein, 145 aa, Homo sapiens
  Payload ID: 10803
  Gene Symbol: NAA10
  Gene Name: N(alpha)-acetyltransferase 10, NatA catalytic subunit
  ENSP ID: ENSP00000413668
MNIRNARPEDLMNMQHCNLLCLPENYQMKYYFYHGLSWPQLSYIAEDENGKIVGEEDPDDVPHGHITSLAVKRSHRRLGLAQKLMDQASRAMIENFNAKYVSLHVRKSNRAALHLYSNTLNFQISEVEPKYYADGEDAYAMKRDL

SEQ ID NO: 54703 - protein, 235 aa, Homo sapiens
  Payload ID: 10803
  Gene Symbol: NAA10
  Gene Name: N(alpha)-acetyltransferase 10, NatA catalytic subunit
  Uniprot ID: P41227
  ENSP ID: ENSP00000417763
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKSNRAALHLYSNTLNFQISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 54704 - protein, 229 aa, Homo sapiens
  Payload ID: 10804
  Gene Symbol: NAA11
  Gene Name: N(alpha)-acetyltransferase 11, NatA catalytic subunit
  Uniprot ID: Q9BSU3
  ENSP ID: ENSP00000286794
MNIRNAQPDDLMNMQHCNLLCLPENYQMKYYLYHGLSWPQLSYIAEDEDGKIVGYVLAKMEEEPDDVPHGHITSLAVKRSHRRLGLAQKLMDQASRAMIENFNAKYVSLHVRKSNRPALHLYSNTLNFQISEVEPKYYADGEDAYAMKRDLSQMADELRRQMDLKKGGYVVLGSRENQETQGSTLSDSEEACQQKNPATEESGSDSKEPKESVESTNVQDSSESSDSTS

SEQ ID NO: 54705 - protein, 111 aa, Homo sapiens
  Payload ID: 10804
  Gene Symbol: NAA11
  Gene Name: N(alpha)-acetyltransferase 11, NatA catalytic subunit
  ENSP ID: ENSP00000422022
LHLYSNTLNFQISEVEPKYYADGEDAYAMKRDLSQMADELRRQMDLKKGGYVVLGSRENQETQGSTLSDSEEACQQKNPATEESGSDSKEPKESVESTNVQDSSESSDSTS

SEQ ID NO: 54706 - protein, 866 aa, Homo sapiens
  Payload ID: 10805
  Gene Symbol: NAA15
  Gene Name: N(alpha)-acetyltransferase 15, NatA auxiliary subunit
  Uniprot ID: Q9BXJ9
  ENSP ID: ENSP00000296543
MPAVSLPPKENALFKRILRCYEHKQYRNGLKFCKQILSNPKFAEHGETLAMKGLTLNCLGKKEEAYELVRRGLRNDLKSHVCWHVYGLLQRSDKKYDEAIKCYRNALKWDKDNLQILRDLSLLQIQMRDLEGYRETRYQLLQLRPAQRASWIGYAIAYHLLEDYEMAAKILEEFRKTQQTSPDKVDYEYSELLLYQNQVLREAGLYREALEHLCTYEKQICDKLAVEETKGELLLQLCRLEDAADVYRGLQERNPENWAYYKGLEKALKPANMLERLKIYEEAWTKYPRGLVPRRLPLNFLSGEKFKECLDKFLRMNFSKGCPPVFNTLRSLYKDKEKVAIIEELVVGYETSLKSCRLFNPNDDGKEEPPTTLLWVQYYLAQHYDKIGQPSIALEYINTAIESTPTLIELFLVKAKIYKHAGNIKEAARWMDEAQALDTADRFINSKCAKYMLKANLIKEAEEMCSKFTREGTSAVENLNEMQCMWFQTECAQAYKAMNKFGEALKKCHEIERHFIEITDDQFDFHTYCMRKITLRSYVDLLKLEDVLRQHPFYFKAARIAIEIYLKLHDNPLTDENKEHEADTANMSDKELKKLRNKQRRAQKKAQIEEEKKNAEKEKQQRNQKKKKDDDDEEIGGPKEELIPEKLAKVETPLEEAIKFLTPLKNLVKNKIETHLFAFEIYFRKEKFLLMLQSVKRAFAIDSSHPWLHECMIRLFNTAVCESKDLSDTVRTVLKQEMNRLFGATNPKNFNETFLKRNSDSLPHRLSAAKMVYYLDPSSQKRAIELATTLDESLTNRNLQTCMEVLEALYDGSLGDCKEAAEIYRANCHKLFPYALAFMPPGYEEDMKITVNGDSSAEAEELANEI

SEQ ID NO: 54707 - protein, 865 aa, Homo sapiens
  Payload ID: 10805
  Gene Symbol: NAA15
  Gene Name: N(alpha)-acetyltransferase 15, NatA auxiliary subunit
  ENSP ID: ENSP00000381920
MPAVSLPPKENALFKRILRCYEHKQYRNGLKFCKQILSNPKFAEHGETLAMKGLTLNCLGKKEEAYELVRRGLRNDLKSHVCWHVYGLLQRSDKKYDEAIKCYRNALKWDKDNLQILRDLSLLQIQMRDLEGYRETRYQLLQLRPAQRASWIGYAIAYHLLEDYEMAAKILEEFRKTQQTSPDKVDYEYSELLLYQNQVLREAGLYREALEHLCTYEKQICDKLAVEETKGELLLQLCRLEDAADVYRGLQERNPENWAYYKGLEKALKPANMLERLKIYEEAWTKYPRGLVPRRLPLNFLSGEKFKECLDKFLRMNFSKGCPPVFNTLRSLYKDKEKVAIIEELVVGYETSLKSCRLFNPNDDGKEEPPTTLLWVQYYLAQHYDKIGQPSIALEYINTAIESTPTLIELFLVKAKIYKHAGNIKEAARWMDEAQALDTADRFINSKCAKYMLKANLIKEAEEMCSKFTREGTSAVENLNEMQCMWFQTECAQAYKAMNKFGEALKKCHEIERHFIEITDDQFDFHTYCMRKITLRSYVDLLKLEDVLRQHPFYFKAARIAIEIYLKLHDNPLTDENKEHEADTANMSDKELKKLRNKQRRAQKKAQIEEEKKNAEKEKQQRNQKKKKDDDDEEIGGPKEELIPEKLAKVETPLEEAIKFLTPLKNLVKNKIETHLFAFEIYFRKEKFLLMLQSVKRAFAIDSSHPWLHECMIRLFNTVCESKDLSDTVRTVLKQEMNRLFGATNPKNFNETFLKRNSDSLPHRLSAAKMVYYLDPSSQKRAIELATTLDESLTNRNLQTCMEVLEALYDGSLGDCKEAAEIYRANCHKLFPYALAFMPPGYEEDMKITVNGDSSAEAEELANEI

SEQ ID NO: 54708 - protein, 98 aa, Homo sapiens
  Payload ID: 10805
  Gene Symbol: NAA15
  Gene Name: N(alpha)-acetyltransferase 15, NatA auxiliary subunit
  ENSP ID: ENSP00000421839
MAVNGCLEGPSSNFLSCLFIVALVGSESTHPLCLEQPATQRCGLAMLPKLIFNSWPQGILPLQPPKALGLQSQQDFQAPGDCLSSGSNTKDLDCKESL

SEQ ID NO: 54709 - protein, 864 aa, Homo sapiens
  Payload ID: 10806
  Gene Symbol: NAA16
  Gene Name: N(alpha)-acetyltransferase 16, NatA auxiliary subunit
  Uniprot ID: Q6N069
  ENSP ID: ENSP00000368716
MPNVLLPPKESNLFKRILKCYEQKQYKNGLKFCKMILSNPKFAEHGETLAMKGLTLNCLGKKEEAYEFVRKGLRNDVKSHVCWHVYGLLQRSDKKYDEAIKCYRNALKLDKDNLQILRDLSLLQIQMRDLEGYRETRYQLLQLRPTQRASWIGYAIAYHLLKDYDMALKLLEEFRQTQQVPPNKIDYEYSELILYQNQVMREADLLQESLEHIEMYEKQICDKLLVEEIKGEILLKLGRLKEASEVFKNLIDRNAENWCYYEGLEKALQISTLEERLQIYEEISKQHPKAITPRRLPLTLVPGERFRELMDKFLRVNFSKGCPPLFTTLKSLYYNTEKVSIIQELVTNYEASLKTCDFFSPYENGEKEPPTTLLWVQYFLAQHFDKLGQYSLALDYINAAIASTPTLIELFYMKAKIYKHIGNLKEAAKWMDEAQSLDTADRFINSKCAKYMLRANMIKEAEEMCSKFTREGTSAMENLNEMQCMWFQTECISAYQRLGRYGDALKKCHEVERHFFEITDDQFDFHTYCMRKMTLRAYVDLLRLEDILRRHAFYFKAARSAIEIYLKLYDNPLTNESKQQEINSENLSAKELKKMLSKQRRAQKKAKLEEERKHAERERQQKNQKKKRDEEEEEASGLKEELIPEKLERVENPLEEAVKFLIPLKNLVADNIDTHLLAFEIYFRKGKFLLMLQSVKRAFAINSNNPWLHECLIRFSKSVSNHSNLPDIVSKVLSQEMQKIFVKKDLESFNEDFLKRNATSLQHLLSGAKMMYFLDKSRQEKAIAIATRLDETIKDKDVKTLIKVSEALLDGSFGNCSSQYEEYRMACHNLLPFTSAFLPAVNEVDNPNVALNHTANYDVLANEI

SEQ ID NO: 54710 - protein, 429 aa, Homo sapiens
  Payload ID: 10806
  Gene Symbol: NAA16
  Gene Name: N(alpha)-acetyltransferase 16, NatA auxiliary subunit
  Uniprot ID: Q6N069
  ENSP ID: ENSP00000386103
MPNVLLPPKESNLFKRILKCYEQKQYKNGLKFCKMILSNPKFAEHGETLAMKGLTLNCLGKKEEAYEFVRKGLRNDVKSHVCWHVYGLLQRSDKKYDEAIKCYRNALKLDKDNLQILRDLSLLQIQMRDLEGYRETRYQLLQLRPTQRASWIGYAIAYHLLKDYDMALKLLEEFRQTQQVPPNKIDYEYSELILYQNQVMREADLLQESLEHIEMYEKQICDKLLVEEIKGEILLKLGRLKEASEVFKNLIDRNAENWCYYEGLEKALQISTLEERLQIYEEISKQHPKAITPRRLPLTLVPGERFRELMDKFLRVNFSKGCPPLFTTLKSLYYNTEKVSIIQELVTNYEASLKTCDFFSPYENGEKEPPTTLLWVQYFLAQHFDKLGQYSLALDYINAAIASTPTLIELFYMKAKIYKVKSESCFLSS

SEQ ID NO: 54711 - protein, 516 aa, Homo sapiens
  Payload ID: 10806
  Gene Symbol: NAA16
  Gene Name: N(alpha)-acetyltransferase 16, NatA auxiliary subunit
  Uniprot ID: Q6N069
  ENSP ID: ENSP00000432364
MPNVLLPPKESNLFKRILKCYEQKQYKNGLKFCKMILSNPKFAEHGETLAMKGLTLNCLGKKEEAYEFVRKGLRNDVKSHVCWHVYGLLQRSDKKYDEAIKCYRNALKLDKDNLQILRDLSLLQIQMRDLEGYRETRYQLLQLRPTQRASWIGYAIAYHLLKDYDMALKLLEEFRQTQQVPPNKIDYEYSELILYQNQVMREADLLQESLEHIEMYEKQICDKLLVEEIKGEILLKLGRLKEASEVFKNLIDRNAENWCYYEGLEKALQISTLEERLQIYEEISKQHPKAITPRRLPLTLVPGERFRELMDKFLRVNFSKGCPPLFTTLKSLYYNTEKVSIIQELVTNYEASLKTCDFFSPYENGEKEPPTTLLWVQYFLAQHFDKLGQYSLALDYINAAIASTPTLIELFYMKAKIYKHIGNLKEAAKWMDEAQSLDTADRFINSKCAKYMLRANMIKEAEEMCSKFTREGTSAMENLNEMQCMWFQTECISAYQRLGRYGDALKKCHEVERVSC

SEQ ID NO: 54712 - protein, 111 aa, Homo sapiens
  Payload ID: 10807
  Gene Symbol: NAA20
  Gene Name: N(alpha)-acetyltransferase 20, NatB catalytic subunit
  Uniprot ID: P61599
  ENSP ID: ENSP00000311027
MTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERYEESTFQGY

SEQ ID NO: 54713 - protein, 178 aa, Homo sapiens
  Payload ID: 10807
  Gene Symbol: NAA20
  Gene Name: N(alpha)-acetyltransferase 20, NatB catalytic subunit
  Uniprot ID: P61599
  ENSP ID: ENSP00000335636
MTTLRAFTCDDLFRFNNINLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 54714 - protein, 166 aa, Homo sapiens
  Payload ID: 10807
  Gene Symbol: NAA20
  Gene Name: N(alpha)-acetyltransferase 20, NatB catalytic subunit
  ENSP ID: ENSP00000381603
MLSQSCNLDPLTETYGIPFYLQYLAHWPEYFIVAEAPGGELMGYIMGKAEGSVAREEWHGHVTALSVAPEFRRLGLAAKLMELLEEISERKGGFFVDLFVRVSNQVAVNMYKQLGYSVYRTVIEYYSASNGEPDEDAYDMRKALSRDTEKKSIIPLPHPVRPEDIE

SEQ ID NO: 54715 - protein, 972 aa, Homo sapiens
  Payload ID: 10808
  Gene Symbol: NAA25
  Gene Name: N(alpha)-acetyltransferase 25, NatB auxiliary subunit
  Uniprot ID: Q14CX7
  ENSP ID: ENSP00000261745
MATRGHVQDPNDRRLRPIYDYLDNGNNKMAIQQADKLLKKHKDLHCAKVLKAIGLQRTGKQEEAFTLAQEVAALEPTDDNSLQALTILYREMHRPELVTKLYEAAVKKVPNSEEYHSHLFMAYARVGEYKKMQQAGMALYKIVPKNPYYFWSVMSLIMQSISAQDENLSKTMFLPLAERMVEKMVKEDKIEAEAEVELYYMILERLGKYQEALDVIRGKLGEKLTSEIQSRENKCMAMYKKLSRWPECNALSRRLLLKNSDDWQFYLTYFDSVFRLIEEAWSPPAEGEHSLEGEVHYSAEKAVKFIEDRITEESKSSRHLRGPHLAKLELIRRLRSQGCNDEYKLGDPEELMFQYFKKFGDKPCCFTDLKVFVDLLPATQCTKFINQLLGVVPLSTPTEDKLALPADIRALQQHLCVVQLTRLLGLYHTMDKNQKLSVVRELMLRYQHGLEFGKTCLKTELQFSDYYCLLAVHALIDVWRETGDETTVWQALTLLEEGLTHSPSNAQFKLLLVRIYCMLGAFEPVVDLYSSLDAKHIQHDTIGYLLTRYAESLGQYAAASQSCNFALRFFHSNQKDTSEYIIQAYKYGAFEKIPEFIAFRNRLNNSLHFAQVRTERMLLDLLLEANISTSLAESIKSMNLRPEEDDIPWEDLRDNRDLNVFFSWDPKDRDVSEEHKKLSLEEETLWLRIRSLTLRLISGLPSLNHPVEPKNSEKTAENGVSSRIDILRLLLQQLEATLETGKRFIEKDIQYPFLGPVPTRMGGFFNSGCSQCQISSFYLVNDIYELDTSGLEDTMEIQERIENSFKSLLDQLKDVFSKCKGDLLEVKDGNLKTHPTLLENLVFFVETISVILWVSSYCESVLRPYKLNLQKKKKKKKETSIIMPPVFTSFQDYVTGLQTLISNVVDHIKGLETHLIALKLEELILEDTSLSPEERKFSKTVQGKVQSSYLHSLLEMGELLKKRLETTKKLKI

SEQ ID NO: 54716 - protein, 37 aa, Homo sapiens
  Payload ID: 10808
  Gene Symbol: NAA25
  Gene Name: N(alpha)-acetyltransferase 25, NatB auxiliary subunit
  ENSP ID: ENSP00000446719
MATRGHVQDPNDRRLRPIYVEMGFHRVSQDGLDLLTS

SEQ ID NO: 54717 - protein, 141 aa, Homo sapiens
  Payload ID: 10808
  Gene Symbol: NAA25
  Gene Name: N(alpha)-acetyltransferase 25, NatB auxiliary subunit
  ENSP ID: ENSP00000447676
  MOD_RES (1)..(1): Any amino acid
XTTGASGPFTVLKAIGLQRTGKQEEAFTLAQEVAALEPTDDNSLQALTILYREMHRPELVTKLYEAAVKKVPNSEEYHSHLFMAYARVGEYKKMQQAGMALYKIVPKNPYYFWSVMSLIMQSISAQDENLSKTMFLPLAER

SEQ ID NO: 54718 - protein, 100 aa, Homo sapiens
  Payload ID: 10808
  Gene Symbol: NAA25
  Gene Name: N(alpha)-acetyltransferase 25, NatB auxiliary subunit
  ENSP ID: ENSP00000448200
MATRGHVQDPNDRRLRPIYDYLDNGNNKMAIQQADKLLKKHKDLHCAKVLKAIGLQRTGKQEEAFTLAQEVAALEPTDDNSLQALTILYREMHRRWHGSI

SEQ ID NO: 54719 - protein, 174 aa, Homo sapiens
  Payload ID: 10809
  Gene Symbol: NAA30
  Gene Name: N(alpha)-acetyltransferase 30, NatC catalytic subunit
  ENSP ID: ENSP00000298406
  MOD_RES (1)..(1): Any amino acid
XATPDGGPRATATKGAGVHSGERPPHSLSSNARTAVPSPVEAAAASDPAAARNGLAEGTEQEEEEEDEQAMVGEECVGAIVCKLDMHKKMFRRGYIAMLAVDSKYRRNGIGTNLVKKAIYAMVEGDCDEVVLETEITNKSALKLYENLGFVRDKRLFRYYLNGVDALRLKLWLR

SEQ ID NO: 54720 - protein, 104 aa, Homo sapiens
  Payload ID: 10809
  Gene Symbol: NAA30
  Gene Name: N(alpha)-acetyltransferase 30, NatC catalytic subunit
  ENSP ID: ENSP00000450939
MVGEECVGAIVCKLDMHKKMFRRGYIAMLAVDSKYRRNGIGTNLVKKAIYAMVEGDCDEVVLETEITNKSALKLYENLGFVRDKRLFRYYLNGVDALRLKLWLR

SEQ ID NO: 54721 - protein, 49 aa, Homo sapiens
  Payload ID: 10809
  Gene Symbol: NAA30
  Gene Name: N(alpha)-acetyltransferase 30, NatC catalytic subunit
  ENSP ID: ENSP00000451255
MVGEECVGAIVCKLDMHKKMFRRGYIAMLAVDSKYRRNGIGCFGNRNNK

SEQ ID NO: 54722 - protein, 362 aa, Homo sapiens
  Payload ID: 10809
  Gene Symbol: NAA30
  Gene Name: N(alpha)-acetyltransferase 30, NatC catalytic subunit
  Uniprot ID: Q147X3
  ENSP ID: ENSP00000452521
MAEVPPGPSSLLPPPAPPAPAAVEPRCPFPAGAALACCSEDEEDDEEHEGGGSRSPAGGESATVAAKGHPCLRCPQPPQEQQQLNGLISPELRHLRAAASLKSKVLSVAEVAATTATPDGGPRATATKGAGVHSGERPPHSLSSNARTAVPSPVEAAAASDPAAARNGLAEGTEQEEEEEDEQVRLLSSSLTADCSLRSPSGREVEPGEDRTIRYVRYESELQMPDIMRLITKDLSEPYSIYTYRYFIHNWPQLCFLAMVGEECVGAIVCKLDMHKKMFRRGYIAMLAVDSKYRRNGIGTNLVKKAIYAMVEGDCDEVVLETEITNKSALKLYENLGFVRDKRLFRYYLNGVDALRLKLWLR

SEQ ID NO: 54723 - protein, 725 aa, Homo sapiens
  Payload ID: 10810
  Gene Symbol: NAA35
  Gene Name: N(alpha)-acetyltransferase 35, NatC auxiliary subunit
  Uniprot ID: Q5VZE5
  ENSP ID: ENSP00000354972
MVMKASVDDDDSGWELSMPEKMEKSNTNWVDITQDFEEACRELKLGELLHDKLFGLFEAMSAIEMMDPKMDAGMIGNQVNRKVLNFEQAIKDGTIKIKDLTLPELIGIMDTCFCCLITWLEGHSLAQTVFTCLYIHNPDFIEDPAMKAFALGILKICDIAREKVNKAAVFEEEDFQSMTYGFKMANSVTDLRVTGMLKDVEDDMQRRVKSTRSRQGEERDPEVELEHQQCLAVFSRVKFTRVLLTVLIAFTKKETSAVAEAQKLMVQAADLLSAIHNSLHHGIQAQNDTTKGDHPIMMGFEPLVNQRLLPPTFPRYAKIIKREEMVNYFARLIDRIKTVCEVVNLTNLHCILDFFCEFSEQSPCVLSRSLLQTTFLVDNKKVFGTHLMQDMVKDALRSFVSPPVLSPKCYLYNNHQAKDCIDSFVTHCVRPFCSLIQIHGHNRARQRDKLGHILEEFATLQDEAEKVDAALHTMLLKQEPQRQHLACLGTWVLYHNLRIMIQYLLSGFELELYSMHEYYYIYWYLSEFLYAWLMSTLSRADGSQMAEERIMEEQQKGRSSKKTKKKKKVRPLSREITMSQAYQNMCAGMFKTMVAFDMDGKVRKPKFELDSEQVRYEHRFAPFNSVMTPPPVHYLQFKEMSDLNKYSPPPQSPELYVAASKHFQQAKMILENIPNPDHEVNRILKVAKPNFVVMKLLAGGHKKESKVPPEFDFSAHKYFPVVKLV

SEQ ID NO: 54724 - protein, 294 aa, Homo sapiens
  Payload ID: 10810
  Gene Symbol: NAA35
  Gene Name: N(alpha)-acetyltransferase 35, NatC auxiliary subunit
  Uniprot ID: Q5VZE5
  ENSP ID: ENSP00000365208
MVMKASVDDDDSGWELSMPEKMEKSNTNWVDITQDFEEACRELKLGELLHDKLFGLFEAMSAIEMMDPKMDAGMIGNQVNRKVLNFEQAIKDGTIKIKDLTLPELIGIMDTCFCCLITWLEGHSLAQTVFTCLYIHNPDFIEDPAMKAFALGILKICDIAREKVNKAAVFEEEDFQSMTYGFKMANSVTDLRVTGMLKDVEDDMQRRVKSTRSRQGEERDPEVELEHQQCLAVFSRVKFTRVLLTVLIAFTKKETSAVAEAQKLMVQAADLLSAIHNSLHHGIQAQNDTTKGGL

SEQ ID NO: 54725 - protein, 173 aa, Homo sapiens
  Payload ID: 10811
  Gene Symbol: NAA38
  Gene Name: N(alpha)-acetyltransferase 38, NatC auxiliary subunit
  Uniprot ID: Q9BRA0
  ENSP ID: ENSP00000332103
MAVAVGVRAAPVLGLARALVLGLRGSQAARWRGWGTAAPGSLWALCECPAGCRELWFRGRAAWAARSERLLHPAQDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 54726 - protein, 73 aa, Homo sapiens
  Payload ID: 10811
  Gene Symbol: NAA38
  Gene Name: N(alpha)-acetyltransferase 38, NatC auxiliary subunit
  ENSP ID: ENSP00000459449
MRIRMTDGRTLVGCFLCTDRDCNVILGSAQEFLKPSDSFSAGEPRVLGLAMVPGHHIVSIEVQRESLTGPPYL

SEQ ID NO: 54727 - protein, 83 aa, Homo sapiens
  Payload ID: 10811
  Gene Symbol: NAA38
  Gene Name: N(alpha)-acetyltransferase 38, NatC auxiliary subunit
  ENSP ID: ENSP00000460085
MRIRMTDGRTLVGCFLCTDRDCNVILGSAQEFLKPSGQCPGNAHPPDSFSAGEPRVLGLAMVPGHHIVSIEVQRESLTGPPYL

SEQ ID NO: 54728 - protein, 125 aa, Homo sapiens
  Payload ID: 10811
  Gene Symbol: NAA38
  Gene Name: N(alpha)-acetyltransferase 38, NatC auxiliary subunit
  Uniprot ID: Q9BRA0
  ENSP ID: ENSP00000460172
MAGAGPTMLLREENGCCSRRQSSSSAGDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 54729 - protein, 135 aa, Homo sapiens
  Payload ID: 10811
  Gene Symbol: NAA38
  Gene Name: N(alpha)-acetyltransferase 38, NatC auxiliary subunit
  ENSP ID: ENSP00000460841
MAGAGPTMLLREENGCCSRRQSSSSAGDSDGEREDSAAERARQQLEALLNKTMRIRMTDGRTLVGCFLCTDRDCNVILGSAQEFLKPSGQCPGNAHPPDSFSAGEPRVLGLAMVPGHHIVSIEVQRESLTGPPYL

SEQ ID NO: 54730 - protein, 99 aa, Homo sapiens
  Payload ID: 10811
  Gene Symbol: NAA38
  Gene Name: N(alpha)-acetyltransferase 38, NatC auxiliary subunit
  ENSP ID: ENSP00000461545
MDSDGEREDSAAERARQQLEALLNKTMRIRMTDGRTLVGCFLCTDRDCNVILGSAQEFLKPSDSFSAGEPRVLGLAMVPGHHIVSIEVQRESLTGPPYL

SEQ ID NO: 54731 - protein, 237 aa, Homo sapiens
  Payload ID: 10812
  Gene Symbol: NAA40
  Gene Name: N(alpha)-acetyltransferase 40, NatD catalytic subunit
  Uniprot ID: Q86UY6
  ENSP ID: ENSP00000367024
MGRKSSKAKEKKQKRLEERAAMDAVCAKVDAANRLGDPLEAFPVFKKYDRNGLNVSIECKRVSGLEPATVDWAFDLTKTNMQTMYEQSEWGWKDREKREEMTDDRAWYLIAWENSSVPVAFSHFRFDVECGDEVLYCYEVQLESKVRRKGLGKFLIQILQLMANSTQMKKVMLTVFKHNHGAYQFFREALQFEIDDSSPSMSGCCGEDCSYEILSRRTKFGDSHHSHAGGHCGGCCH

SEQ ID NO: 54732 - protein, 124 aa, Homo sapiens
  Payload ID: 10812
  Gene Symbol: NAA40
  Gene Name: N(alpha)-acetyltransferase 40, NatD catalytic subunit
  ENSP ID: ENSP00000438639
MGRKSSKAKEKKQKRLEERAAMDAVCAKVDAANRLGDPLEAFPVFKKYDRNGTQMKKVMLTVFKHNHGAYQFFREALQFEIDDSSPSMSGCCGEDCSYEILSRRTKFGDSHHSHAGGHCGGCCH

SEQ ID NO: 54733 - protein, 39 aa, Homo sapiens
  Payload ID: 10812
  Gene Symbol: NAA40
  Gene Name: N(alpha)-acetyltransferase 40, NatD catalytic subunit
  ENSP ID: ENSP00000440304
MGRKSSKAKEKKQKRLEERAAMDAVCAKVDAANRVECLH

SEQ ID NO: 54734 - protein, 69 aa, Homo sapiens
  Payload ID: 10812
  Gene Symbol: NAA40
  Gene Name: N(alpha)-acetyltransferase 40, NatD catalytic subunit
  ENSP ID: ENSP00000440849
MGRKSSKAKEKKQKRLEERAAMDAVCAKVDAANRVMPNLTLLGLSTKAFLAHVTSELGKWWVLGGCSWF

SEQ ID NO: 54735 - protein, 216 aa, Homo sapiens
  Payload ID: 10812
  Gene Symbol: NAA40
  Gene Name: N(alpha)-acetyltransferase 40, NatD catalytic subunit
  Uniprot ID: Q86UY6
  ENSP ID: ENSP00000442055
MDAVCAKVDAANRLGDPLEAFPVFKKYDRNGLNVSIECKRVSGLEPATVDWAFDLTKTNMQTMYEQSEWGWKDREKREEMTDDRAWYLIAWENSSVPVAFSHFRFDVECGDEVLYCYEVQLESKVRRKGLGKFLIQILQLMANSTQMKKVMLTVFKHNHGAYQFFREALQFEIDDSSPSMSGCCGEDCSYEILSRRTKFGDSHHSHAGGHCGGCCH

SEQ ID NO: 54736 - protein, 169 aa, Homo sapiens
  Payload ID: 10813
  Gene Symbol: NAA50
  Gene Name: N(alpha)-acetyltransferase 50, NatE catalytic subunit
  Uniprot ID: Q9GZZ1
  ENSP ID: ENSP00000240922
MKGSRIELGDVTPHNIKQLKRLNQVIFPVSYNDKFYKDVLEVGELAKLAYFNDIAVGAVCCRVDHSQNQKRLYIMTLGCLAPYRRLGIGTKMLNHVLNICEKDGTFDNIYLHVQISNESAIDFYRKFGFEIIETKKNYYKRIEPADAHVLQKNLKVPSGQNADVQKTDN

SEQ ID NO: 54737 - protein, 129 aa, Homo sapiens
  Payload ID: 10813
  Gene Symbol: NAA50
  Gene Name: N(alpha)-acetyltransferase 50, NatE catalytic subunit
  ENSP ID: ENSP00000417110
MKGSRIELGDVTPHNIKQLKRLNQVIFPVSYNDKFYKDVLEVGELAKLGTKMLNHVLNICEKDGTFDNIYLHVQISNESAIDFYRKFGFEIIETKKNYYKRIEPADAHVLQKNLKVPSGQNADVQKTDN

SEQ ID NO: 54738 - protein, 95 aa, Homo sapiens
  Payload ID: 10813
  Gene Symbol: NAA50
  Gene Name: N(alpha)-acetyltransferase 50, NatE catalytic subunit
  ENSP ID: ENSP00000417488
MTLGCLAPYRRLGIGTKMLNHVLNICEKDGTFDNIYLHVQISNESAIDFYRKFGFEIIETKKNYYKRIEPADAHVLQKNLKVPSGQNADVQKTDN

SEQ ID NO: 54739 - protein, 168 aa, Homo sapiens
  Payload ID: 10813
  Gene Symbol: NAA50
  Gene Name: N(alpha)-acetyltransferase 50, NatE catalytic subunit
  ENSP ID: ENSP00000417837
MKGRIELGDVTPHNIKQLKRLNQVIFPVSYNDKFYKDVLEVGELAKLAYFNDIAVGAVCCRVDHSQNQKRLYIMTLGCLAPYRRLGIGTKMLNHVLNICEKDGTFDNIYLHVQISNESAIDFYRKFGFEIIETKKNYYKRIEPADAHVLQKNLKVPSGQNADVQKTDN

SEQ ID NO: 54740 - protein, 48 aa, Homo sapiens
  Payload ID: 10813
  Gene Symbol: NAA50
  Gene Name: N(alpha)-acetyltransferase 50, NatE catalytic subunit
  ENSP ID: ENSP00000418323
MKGSRIELGDVTPHNIKQLKRLNQVIFPVSYNDKFYKDVLEPISMILL

SEQ ID NO: 54741 - protein, 95 aa, Homo sapiens; identical to SEQ ID NO: 54738
  Payload ID: 10813
  Gene Symbol: NAA50
  Gene Name: N(alpha)-acetyltransferase 50, NatE catalytic subunit
  ENSP ID: ENSP00000418473

SEQ ID NO: 54742 - protein, 58 aa, Homo sapiens
  Payload ID: 10813
  Gene Symbol: NAA50
  Gene Name: N(alpha)-acetyltransferase 50, NatE catalytic subunit
  ENSP ID: ENSP00000418490
MKGRIELGDVTPHNIKQLKRLNQVIFPVSYNDKFYKDVLEKNLKVPSGQNADVQKTDN

SEQ ID NO: 54743 - protein, 57 aa, Homo sapiens
  Payload ID: 10813
  Gene Symbol: NAA50
  Gene Name: N(alpha)-acetyltransferase 50, NatE catalytic subunit
  ENSP ID: ENSP00000419729
MKGRIELGDVTPHNIKQLKRLNQVIFPVSYNDKFYKDVLEVGELAKLGAVCCRVDHS

SEQ ID NO: 54744 - protein, 81 aa, Homo sapiens
  Payload ID: 10813
  Gene Symbol: NAA50
  Gene Name: N(alpha)-acetyltransferase 50, NatE catalytic subunit
  ENSP ID: ENSP00000480264
MKGSRIELGDVTPHNIKQLKRLNQVIFPVSYNDKFYKKFGFEIIETKKNYYKRIEPADAHVLQKNLKVPSGQNADVQKTDN

SEQ ID NO: 54745 - protein, 58 aa, Homo sapiens
  Payload ID: 10813
  Gene Symbol: NAA50
  Gene Name: N(alpha)-acetyltransferase 50, NatE catalytic subunit
  ENSP ID: ENSP00000486244
MGSRIELGDVTPHNIKQLKRLNQVIFPVSYNDKFYKDVLEKNLKVPSGQNADVQKTDN

SEQ ID NO: 54746 - protein, 177 aa, Homo sapiens
  Payload ID: 10814
  Gene Symbol: NAA60
  Gene Name: N(alpha)-acetyltransferase 60, NatF catalytic subunit
  Uniprot ID: Q9H7X0
  ENSP ID: ENSP00000354108
MIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIRGVLKDGFTYVLYINGGHPPWTILDYIQHLGSALASLSPCSIPHRVYRQAHSLLCSFLPWSGISSKSGIEYSRTM

SEQ ID NO: 54747 - protein, 242 aa, Homo sapiens
  Payload ID: 10814
  Gene Symbol: NAA60
  Gene Name: N(alpha)-acetyltransferase 60, NatF catalytic subunit
  Uniprot ID: Q9H7X0
  ENSP ID: ENSP00000385903
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIRGVLKDGFTYVLYINGGHPPWTILDYIQHLGSALASLSPCSIPHRVYRQAHSLLCSFLPWSGISSKSGIEYSRTM

SEQ ID NO: 54748 - protein, 242 aa, Homo sapiens; identical to SEQ ID NO: 54747
  Payload ID: 10814
  Gene Symbol: NAA60
  Gene Name: N(alpha)-acetyltransferase 60, NatF catalytic subunit
  Uniprot ID: Q9H7X0
  ENSP ID: ENSP00000393224

SEQ ID NO: 54749 - protein, 249 aa, Homo sapiens
  Payload ID: 10814
  Gene Symbol: NAA60
  Gene Name: N(alpha)-acetyltransferase 60, NatF catalytic subunit
  Uniprot ID: Q9H7X0
  ENSP ID: ENSP00000401237
MFPRRRTERRLGDTGTRKKIAYRKAVPGGRKCGASLSWEKSSREYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIRGVLKDGFTYVLYINGGHPPWTILDYIQHLGSALASLSPCSIPHRVYRQAHSLLCSFLPWSGISSKSGIEYSRTM

SEQ ID NO: 54750 - protein, 190 aa, Homo sapiens
  Payload ID: 10814
  Gene Symbol: NAA60
  Gene Name: N(alpha)-acetyltransferase 60, NatF catalytic subunit
  Uniprot ID: Q9H7X0
  ENSP ID: ENSP00000405873
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIEPHGLHPAPGLCTSQPEPLLHSAQSLPPGPQPALQLPAMVGHLFQEWHRVQPDHVMSAGQPPPGPTLRPPAEPAFLSI

SEQ ID NO: 54751 - protein, 99 aa, Homo sapiens
  Payload ID: 10814
  Gene Symbol: NAA60
  Gene Name: N(alpha)-acetyltransferase 60, NatF catalytic subunit
  ENSP ID: ENSP00000458505
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYIL

SEQ ID NO: 54752 - protein, 134 aa, Homo sapiens
  Payload ID: 10814
  Gene Symbol: NAA60
  Gene Name: N(alpha)-acetyltransferase 60, NatF catalytic subunit
  ENSP ID: ENSP00000458575
MTEVVPSSALSEVSLRLLCHDDIDTVKHLCGDWFPIEYPDSWYRDITSNKKFFSLAATYRGAIVGMIVAEIKNRTKIHKESPTDYIQHLGSALASLSPCSIPHRVYRQAHSLLCSFLPWSGISSKSGIEYSRTM

SEQ ID NO: 54753 - protein, 242 aa, Homo sapiens; identical to SEQ ID NO: 54747
  Payload ID: 10814
  Gene Symbol: NAA60
  Gene Name: N(alpha)-acetyltransferase 60, NatF catalytic subunit
  Uniprot ID: Q9H7X0
  ENSP ID: ENSP00000458667

SEQ ID NO: 54754 - protein, 41 aa, Homo sapiens
  Payload ID: 10814
  Gene Symbol: NAA60
  Gene Name: N(alpha)-acetyltransferase 60, NatF catalytic subunit
  ENSP ID: ENSP00000458717
MTEVVPSSALSEVSLRLLCHDDIDTVKHLCGDWFPIEMEIF

SEQ ID NO: 54755 - protein, 109 aa, Homo sapiens
  Payload ID: 10814
  Gene Symbol: NAA60
  Gene Name: N(alpha)-acetyltransferase 60, NatF catalytic subunit
  ENSP ID: ENSP00000458928
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRK

SEQ ID NO: 54756 - protein, 177 aa, Homo sapiens; identical to SEQ ID NO: 54746
  Payload ID: 10814
  Gene Symbol: NAA60
  Gene Name: N(alpha)-acetyltransferase 60, NatF catalytic subunit
  Uniprot ID: Q9H7X0
  ENSP ID: ENSP00000459055

SEQ ID NO: 54757 - protein, 242 aa, Homo sapiens; identical to SEQ ID NO: 54747
  Payload ID: 10814
  Gene Symbol: NAA60
  Gene Name: N(alpha)-acetyltransferase 60, NatF catalytic subunit
  Uniprot ID: Q9H7X0
  ENSP ID: ENSP00000459057

SEQ ID NO: 54758 - protein, 129 aa, Homo sapiens
  Payload ID: 10814
  Gene Symbol: NAA60
  Gene Name: N(alpha)-acetyltransferase 60, NatF catalytic subunit
  ENSP ID: ENSP00000459084
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESLKDHISTTAQ

SEQ ID NO: 54759 - protein, 77 aa, Homo sapiens
  Payload ID: 10814
  Gene Symbol: NAA60
  Gene Name: N(alpha)-acetyltransferase 60, NatF catalytic subunit
  ENSP ID: ENSP00000459188
MTEVVPSSALSEVSLRLLCHDDIDTVKHLCGDWFPIEYPDSWYRDITSNKKFFSLAATYRGAIVGMIVAEIKNRTKI

SEQ ID NO: 54760 - protein, 106 aa, Homo sapiens
  Payload ID: 10814
  Gene Symbol: NAA60
  Gene Name: N(alpha)-acetyltransferase 60, NatF catalytic subunit
  ENSP ID: ENSP00000459275
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKE

SEQ ID NO: 54761 - protein, 120 aa, Homo sapiens
  Payload ID: 10814
  Gene Symbol: NAA60
  Gene Name: N(alpha)-acetyltransferase 60, NatF catalytic subunit
  ENSP ID: ENSP00000459544
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESL

SEQ ID NO: 54762 - protein, 141 aa, Homo sapiens
  Payload ID: 10814
  Gene Symbol: NAA60
  Gene Name: N(alpha)-acetyltransferase 60, NatF catalytic subunit
  ENSP ID: ENSP00000459750
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLT

SEQ ID NO: 54763 - protein, 121 aa, Homo sapiens
  Payload ID: 10814
  Gene Symbol: NAA60
  Gene Name: N(alpha)-acetyltransferase 60, NatF catalytic subunit
  ENSP ID: ENSP00000459790
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESLK

SEQ ID NO: 54764 - protein, 179 aa, Homo sapiens
  Payload ID: 10814
  Gene Symbol: NAA60
  Gene Name: N(alpha)-acetyltransferase 60, NatF catalytic subunit
  Uniprot ID: Q9H7X0
  ENSP ID: ENSP00000460763
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIESTARPTACSAASCHGRASLPRVASSTAGPCDVGWAAATRPHPSAARRARLPVHLTPSVFCKELPAI

SEQ ID NO: 54765 - protein, 87 aa, Homo sapiens
  Payload ID: 10814
  Gene Symbol: NAA60
  Gene Name: N(alpha)-acetyltransferase 60, NatF catalytic subunit
  ENSP ID: ENSP00000461438
MTEVVPSSALSEVSLRLLCHDDIDTVKHLCGDWFPIEYPDSWYRDITSNKKFFSLAATYRGAIVGMIVAEIKNRTKIHKEVPSYLKV

SEQ ID NO: 54766 - protein, 93 aa, Homo sapiens
  Payload ID: 10814
  Gene Symbol: NAA60
  Gene Name: N(alpha)-acetyltransferase 60, NatF catalytic subunit
  ENSP ID: ENSP00000461443
MTEVVPSSALSEVSLRLLCHDDIDTVKHLCGDWFPIEYPDSWYRDITSNKKFFSLAATYRGAIVGMIVAEIKNRTKIHKEDGDILASNFSVDT

SEQ ID NO: 54767 - protein, 80 aa, Homo sapiens
  Payload ID: 10814
  Gene Symbol: NAA60
  Gene Name: N(alpha)-acetyltransferase 60, NatF catalytic subunit
  ENSP ID: ENSP00000461507
MTEVVPSSALSEVSLRLLCHDDIDTVKHLCGDWFPIEYPDSWYRDITSNKKFFSLAATYRGAIVGMIVAEIKNRTKIHKE

SEQ ID NO: 54768 - protein, 134 aa, Homo sapiens; identical to SEQ ID NO: 54752
  Payload ID: 10814
  Gene Symbol: NAA60
  Gene Name: N(alpha)-acetyltransferase 60, NatF catalytic subunit
  ENSP ID: ENSP00000461703

SEQ ID NO: 54769 - protein, 179 aa, Homo sapiens; identical to SEQ ID NO: 54764
  Payload ID: 10814
  Gene Symbol: NAA60
  Gene Name: N(alpha)-acetyltransferase 60, NatF catalytic subunit
  Uniprot ID: Q9H7X0
  ENSP ID: ENSP00000461730

SEQ ID NO: 54770 - protein, 48 aa, Homo sapiens
  Payload ID: 10814
  Gene Symbol: NAA60
  Gene Name: N(alpha)-acetyltransferase 60, NatF catalytic subunit
  ENSP ID: ENSP00000482351
MFPRRRTERRLGDTGTRKKIAYRKAVPGGRKCGASLSWEKSSRDVKTD

SEQ ID NO: 54771 - protein, 186 aa, Homo sapiens
  Payload ID: 10815
  Gene Symbol: N6AMT1
  Gene Name: N-6 adenine-specific DNA methyltransferase 1 (putative)
  Uniprot ID: Q9Y5N5
  ENSP ID: ENSP00000286764
MAGENFATPFHGHVGRGAFSDVYEPAEDTFLLLDALEAAAAELAGVEICLEVGSGSGVVSAFLASMIGPQALYMCTDINPEAAACTLETARCNKVHIQPVITDLVGSHGIEAAWAGGRNGREVMDRFFPLVPDLLSPRGLFYLVTIKENNPEEILKIMKTKGLQGTTALSRQAGQETLSVLKFTKS

SEQ ID NO: 54772 - protein, 214 aa, Homo sapiens
  Payload ID: 10815
  Gene Symbol: N6AMT1
  Gene Name: N-6 adenine-specific DNA methyltransferase 1 (putative)
  ENSP ID: ENSP00000303584
MAGENFATPFHGHVGRGAFSDVYEPAEDTFLLLDALEAAAAELAGVEICLEVGSGSGVVSAFLASMIGPQALYMCTDINPEAAACTLETARCNKVHIQPVITDLVKGLLPRLTEKVDLLVFNPPYVVTPPQEVGSHGIEAAWAGGRNGREVMDRFFPLVPDLLSPRGLFYLVTIKENNPEEILKIMKTKGLQGTTALSRQAGQETLSVLKFTKS

SEQ ID NO: 54773 - protein, 214 aa, Homo sapiens; identical to SEQ ID NO: 54772
  Payload ID: 10815
  Gene Symbol: N6AMT1
  Gene Name: N-6 adenine-specific DNA methyltransferase 1 (putative)
  ENSP ID: ENSP00000436490

SEQ ID NO: 54774 - protein, 214 aa, Homo sapiens
  Payload ID: 10816
  Gene Symbol: N6AMT2
  Gene Name: N-6 adenine-specific DNA methyltransferase 2 (putative)
  Uniprot ID: Q8WVE0
  ENSP ID: ENSP00000372202
MSDLEDDETPQLSAHALAALQEFYAEQKQQIEPGEDDKYNIGIIEENWQLSQFWYSQETALQLAQEAIAAVGEGGRIACVSAPSVYQKLRELCRENFSIYIFEYDKRFAMYGEEFIFYDYNNPLDLPERIAAHSFDIVIADPPYLSEECLRKTSETVKYLTRGKILLCTGAIMEEQAAELLGVKMCTFVPRHTRNLANEFRCYVNYDSGLDCGI

SEQ ID NO: 54775 - protein, 214 aa, Homo sapiens; identical to SEQ ID NO: 54774
  Payload ID: 10816
  Gene Symbol: N6AMT2
  Gene Name: N-6 adenine-specific DNA methyltransferase 2 (putative)
  Uniprot ID: Q8WVE0
  ENSP ID: ENSP00000372206

SEQ ID NO: 54776 - protein, 207 aa, Homo sapiens
  Payload ID: 10817
  Gene Symbol: NKAIN1
  Gene Name: Na+/K+ transporting ATPase interacting 1
  Uniprot ID: Q4KMZ8
  ENSP ID: ENSP00000362841
MGKCSGRCTLVAFCCLQLVAALERQIFDFLGYQWAPILANFLHIMAVILGIFGTVQYRSRYLILYAAWLVLWVGWNAFIICFYLEVGQLSQDRDFIMTFNTSLHRSWWMENGPGCLVTPVLNSRLALEDHHVISVTGCLLDYPYIEALSSALQIFLALFGFVFACYVSKVFLEEEDSFDFIGGFDSYGYQAPQKTSHLQLQPLYTSG

SEQ ID NO: 54777 - protein, 151 aa, Homo sapiens
  Payload ID: 10817
  Gene Symbol: NKAIN1
  Gene Name: Na+/K+ transporting ATPase interacting 1
  ENSP ID: ENSP00000433225
  MOD_RES (1)..(1): Any amino acid
XGYQWAPILANFLHIMAVILGIFGTVQYRSRYLILDRDFIMTFNTSLHRSWWMENGPGCLVTPVLNSRLALEDHHVISVTGCLLDYPYIEALSSALQIFLALFGFVFACYVSKVFLEEEDSFDFIGGFDSYGYQAPQKTSHLQLQPLYTSG

SEQ ID NO: 54778 - protein, 126 aa, Homo sapiens
  Payload ID: 10817
  Gene Symbol: NKAIN1
  Gene Name: Na+/K+ transporting ATPase interacting 1
  ENSP ID: ENSP00000473611
MAVILGIFGTVQYRSRYLILYAAWLVLWVGWNAFIICFYLEVGQLSQDRDFIMTFNTSLHRSWWMENGPGCLVTPVLNSRLALEDHHVISVTGCLLDYPYIEALSSALQIFLALFGFVFACYVSKV

SEQ ID NO: 54779 - protein, 188 aa, Homo sapiens
  Payload ID: 10818
  Gene Symbol: NKAIN2
  Gene Name: Na+/K+ transporting ATPase interacting 2
  Uniprot ID: Q5VXU1
  ENSP ID: ENSP00000357401
MGYCSGRCTLIFICGMQLVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLAVSVGSQPLLLVPLGLFYFCANSVHTNGICG

SEQ ID NO: 54780 - protein, 208 aa, Homo sapiens
  Payload ID: 10818
  Gene Symbol: NKAIN2
  Gene Name: Na+/K+ transporting ATPase interacting 2
  Uniprot ID: Q5VXU1
  ENSP ID: ENSP00000357402
MGYCSGRCTLIFICGMQLVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLALAGFIYACYVVKCITEEEDSFDFIGGFDSYGYQGPQKTSHLQLQPMYMSK

SEQ ID NO: 54781 - protein, 207 aa, Homo sapiens
  Payload ID: 10818
  Gene Symbol: NKAIN2
  Gene Name: Na+/K+ transporting ATPase interacting 2
  Uniprot ID: Q5VXU1
  ENSP ID: ENSP00000437798
MGIIRFLLLYCPTNILTVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLALAGFIYACYVVKCITEEEDSFDFIGGFDSYGYQGPQKTSHLQLQPMYMSK

SEQ ID NO: 54782 - protein, 49 aa, Homo sapiens
  Payload ID: 10818
  Gene Symbol: NKAIN2
  Gene Name: Na+/K+ transporting ATPase interacting 2
  ENSP ID: ENSP00000440287
VCVLERQIFDFLGYQWAPILANFVHIIIVILGLFGTIQYRPRYITGYHV

SEQ ID NO: 54783 - protein, 197 aa, Homo sapiens
  Payload ID: 10819
  Gene Symbol: NKAIN3
  Gene Name: Na+/K+ transporting ATPase interacting 3
  Uniprot ID: Q8N8D7
  ENSP ID: ENSP00000429073
MGCCTGRCSLICLCALQLVSALERQIFDFLGFQWAPILGNFLHIIVVILGLFGTIQYRPRYIMVYTVWTALWVTWNVFIICFYLEVGGLSKDTDLMTFNISVHRSWWREHGPGCVRRVLPPSAHGMMDDYTYVSVTGCIVDFQYLEVIHSAVQILLSLVGFVYACYVISISMEEEDTYSCDLQVCKHLFIQMLQIIE

SEQ ID NO: 54784 - protein, 101 aa, Homo sapiens
  Payload ID: 10819
  Gene Symbol: NKAIN3
  Gene Name: Na+/K+ transporting ATPase interacting 3
  ENSP ID: ENSP00000429393
MGCCTGRCSLICLCALQLVSALERQIFDFLGFQWAPILGNFLHIIVVILGLFGTIQYRPRYIMVDTDLMTFNISVHRSWWREHGPGCVRRVLPPSAHGMMD

SEQ ID NO: 54785 - protein, 146 aa, Homo sapiens
  Payload ID: 10820
  Gene Symbol: NKAIN4
  Gene Name: Na+/K+ transporting ATPase interacting 4
  ENSP ID: ENSP00000359330
MVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 54786 - protein, 119 aa, Homo sapiens
  Payload ID: 10820
  Gene Symbol: NKAIN4
  Gene Name: Na+/K+ transporting ATPase interacting 4
  ENSP ID: ENSP00000359336
MVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSCLRK

SEQ ID NO: 54787 - protein, 208 aa, Homo sapiens
  Payload ID: 10820
  Gene Symbol: NKAIN4
  Gene Name: Na+/K+ transporting ATPase interacting 4
  Uniprot ID: Q8IVV8
  ENSP ID: ENSP00000359340
MGSCSGRCALVVLCAFQLVAALERQVFDFLGYQWAPILANFVHIIIVILGLFGTIQYRLRYVMVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 54788 - protein, 167 aa, Homo sapiens
  Payload ID: 10820
  Gene Symbol: NKAIN4
  Gene Name: Na+/K+ transporting ATPase interacting 4
  ENSP ID: ENSP00000359341
VWVTWNVFIICFYLEVGGLLKDSELLTFSLSRHRSWWRERWPGCLHEEVPAVGLGAPHGQALVSGAGCALEPSYVEALHSCLQILIANPRWLAPQRRRNPWWLLAGVGWGQSFWALSVAARWSACLRRKRTALISLVDLIHFLSTMSMKSHPVSCPSRCTSPQARPH

SEQ ID NO: 54789 - protein, 1562 aa, Homo sapiens
  Payload ID: 10821
  Gene Symbol: NACAD
  Gene Name: NAC alpha domain containing
  Uniprot ID: O15069
  ENSP ID: ENSP00000420477
MPGEAARAELLLPEADRPGPRTDLSCDAAAATTILGGDRREPCALTPGPSHLALTFLPSKPGARPQPEGASWDAGPGGAPSAWADPGEGGPSPMLLPEGLSSQALSTEAPLPATLEPRIVMGEETCQALLSPRAARTALRDQEGGHASPDPPPELCSQGDLSVPSPPPDPDSFFTPPSTPTKTTYALLPACGPHGDARDSEAELRDELLDSPPASPSGSYITADGDSWASSPSCSLSLLAPAEGLDFPSGWGLSPQGSMVDERELHPAGTPEPPSSESSLSADSSSSWGQEGHFFDLDFLANDPMIPAALLPFQGSLIFQVEAVEVTPLSPEEEEEEAVADPDPGGDLAGEGEEDSTSASFLQSLSDLSITEGMDEAFAFRDDTSAASSDSDSASYAEADDERLYSGEPHAQATLLQDSVQKTEEESGGGAKGLQAQDGTVSWAVEAAPQTSDRGAYLSQRQELISEVTEEGLALGQESTATVTPHTLQVAPGLQVEVATRVTPQAGEEETDSTAGQESAAMAMPQPSQEGISEILGQESVTAEKLPTPQEETSLTLCPDSPQNLKEEGGLDLPSGRKPVAAATIVPRQAKEDLTLPQDSAMTPPLPLQDTDLSSAPKPVAAATIVSQQAEEGLTLPQDSVMTPPLPLQDTELSSAPKPVAAATLVSQQAEEGLTLPQDSAMTPPLPLQDTDLSSAPKPVAAATLVSQQAEEGLTLPQDSAMTPPLPLQDTDLSSAPKPVAAATLVSQQAEEGLTLPQDSAMTPPLPLQDTDLSSAPKPVAAATIVSQQAEEGLTLPQDSAMTPPLPLQDTDLSSAPKPVAAATIVSQQAEEGLTLPQDSAMTPPLPLQDTDLSSAPKPVAAATPVSQQAEEGLTLPQDSAMTPPLPLQDTDLSSAPKPVAAATPVSQQAEEGLTLPQDSAMTAPLPLQDTGPTSGPEPLAVATPQTLQAEAGCAPGTEPVATMAQQEVGEALGPRPAPEEKNAALPTVPEPAALDQVQQDDPQPAAEAGTPWAAQEDADSTLGMEALSLPEPASGAGEEIAEALSRPGREACLEARAHTGDGAKPDSPQKETLEVENQQEGGLKPLAQEHGPRSALGGAREVPDAPPAACPEVSQARLLSPAREERGLSGKSTPEPTLPSAVATEASLDSCPESSVGAVSSLDRGCPDAPAPTSAPTSQQPEPVLGLGSVEQPHEVPSVLGTPLLQPPENLAKGQPSTPVDRPLGPDPSAPGTLAGAALPPLEPPAPCLCQDPQEDSVEDEEPPGSLGLPPPQAGVQPAAAAVSGTTQPLGTGPRVSLSPHSPLLSPKVASMDAKDLALQILPPCQVPPPSGPQSPAGPQGLSAPEQQEDEDSLEEDSPRALGSGQHSDSHGESSAELDEQDILAPQTVQCPAQAPAGGSEETIAKAKQSRSEKKARKAMSKLGLRQIQGVTRITIQKSKNILFVIAKPDVFKSPASDTYVVFGEAKIEDLSQQVHKAAAEKFKVPSEPSALVPESAPRPRVRLECKEEEEEEEEEVDEAGLELRDIELVMAQANVSRAKAVRALRDNHSDIVNAIMELTM

SEQ ID NO: 54790 - protein, 587 aa, Homo sapiens
  Payload ID: 10822
  Gene Symbol: NACC2
  Gene Name: NACC family member 2, BEN and BTB (POZ) domain containing
  Uniprot ID: Q96BF6
  ENSP ID: ENSP00000277554
MSQMLHIEIPNFGNTVLGCLNEQRLLGLYCDVSIVVKGQAFKAHRAVLAASSLYFRDLFSGNSKSAFELPGSVPPACFQQILSFCYTGRLTMTASEQLVVMYTAGFLQIQHIVERGTDLMFKVSSPHCDSQTAVIEDAGSEPQSPCNQLQPAAAAAAPYVVSPSVPIPLLTRVKHEAMELPPAGPGLAPKRPLETGPRDGVAVAAGAAVAAGTAPLKLPRVSYYGVPSLATLIPGIQQMPYPQGERTSPGASSLPTTDSPTSYHNEEDEEDDEAYDTMVEEQYGQMYIKASGSYAVQEKPEPVPLESRSCVLIRRDLVALPASLISQIGYRCHPKLYSEGDPGEKLELVAGSGVYITRGQLMNCHLCAGVKHKVLLRRLLATFFDRNTLANSCGTGIRSSTSDPSRKPLDSRVLNAVKLYCQNFAPSFKESEMNVIAADMCTNARRVRKRWLPKIKSMLPEGVEMYRTVMGSAAASVPLDPEFPPAAAQVFEQRIYAERRGDAATIVALRTDAVNVDLSAAANPAFDAGEEVDGAGSVIQEVAAPEPLPADGQSPPQPFEQGGGGPSRPQTPAAAARRPEGTYAGTL

SEQ ID NO: 54791 - protein, 587 aa, Homo sapiens; identical to SEQ ID NO: 54790
  Payload ID: 10822
  Gene Symbol: NACC2
  Gene Name: NACC family member 2, BEN and BTB (POZ) domain containing
  Uniprot ID: Q96BF6
  ENSP ID: ENSP00000360818

SEQ ID NO: 54792 - protein, 707 aa, Homo sapiens
  Payload ID: 10823
  Gene Symbol: NAALAD2
  Gene Name: N-acetylated alpha-linked acidic dipeptidase 2
  ENSP ID: ENSP00000320083
MAESRGRLYLWMCLAAALASFLMGFMVGWFIKPLKETTTSVRYHQSIRWKLVSEMKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKEYTFRLDVEEGVGIPRIPVHPIGYNDAEILLRKVRMHVYNINKITRIYNVVGTIRGSVEPDRYVILGGHRDSWVFGAIDPTSGVAVLQEIARSFGKLMSKGWRPRRTIIFASWDAEEFGLLGSTEWAEENVKILQERSIAYINSDSSIEGNYTLRVDCTPLLYQLVYKLTKEIPSPDDGFESKSLYESWLEKDPSPENKNLPRINKLGSGSDFEAYFQRLGIASGRARYTKNKKTDKYSSYPVYHTIYETFELVEKFYDPTFKKQLSVAQLRGALVYELVDSKIIPFNIQDYAEALKNYAASIYNLSKKHDQQLTDHGVSFDSLFSAVKNFSEAASDFHKRLIQVDLNNPIAVRMMNDQLMLLERAFIDPLGLPGKLFYRHIIFAPSSHNKYAGESFPGIYDAIFDIENKANSRLAWKEVKKHISIAAFTIQAAAGTLKEVL

SEQ ID NO: 54793 - protein, 305 aa, Homo sapiens
  Payload ID: 10823
  Gene Symbol: NAALAD2
  Gene Name: N-acetylated alpha-linked acidic dipeptidase 2
  Uniprot ID: Q9Y3Q0
  ENSP ID: ENSP00000365111
MAESRGRLYLWMCLAAALASFLMGFMVGWFIKPLKETTTSVRYHQSIRWKLVSEMKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKGTSYLLQVATTNMLENHFLESMMLSLILKIKPTLVWPGKK

SEQ ID NO: 54794 - protein, 88 aa, Homo sapiens
  Payload ID: 10823
  Gene Symbol: NAALAD2
  Gene Name: N-acetylated alpha-linked acidic dipeptidase 2
  ENSP ID: ENSP00000431989
MAESRGRLYLWMCLAAALASFLMGFMVGWFIKPLKETTTSVRYHQSIRWKLVSEMKAENIKSFLRSFTKLPHLAGTEQNFLLAKKIQT

SEQ ID NO: 54795 - protein, 740 aa, Homo sapiens
  Payload ID: 10823
  Gene Symbol: NAALAD2
  Gene Name: N-acetylated alpha-linked acidic dipeptidase 2
  Uniprot ID: Q9Y3Q0
  ENSP ID: ENSP00000432481
MAESRGRLYLWMCLAAALASFLMGFMVGWFIKPLKETTTSVRYHQSIRWKLVSEMKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKEYTFRLDVEEGVGIPRIPVHPIGYNDAEILLRYLGGIAPPDKSWKGALNVSYSIGPGFTGSDSFRKVRMHVYNINKITRIYNVVGTIRGSVEPDRYVILGGHRDSWVFGAIDPTSGVAVLQEIARSFGKLMSKGWRPRRTIIFASWDAEEFGLLGSTEWAEENVKILQERSIAYINSDSSIEGNYTLRVDCTPLLYQLVYKLTKEIPSPDDGFESKSLYESWLEKDPSPENKNLPRINKLGSGSDFEAYFQRLGIASGRARYTKNKKTDKYSSYPVYHTIYETFELVEKFYDPTFKKQLSVAQLRGALVYELVDSKIIPFNIQDYAEALKNYAASIYNLSKKHDQQLTDHGVSFDSLFSAVKNFSEAASDFHKRLIQVDLNNPIAVRMMNDQLMLLERAFIDPLGLPGKLFYRHIIFAPSSHNKYAGESFPGIYDAIFDIENKANSRLAWKEVKKHISIAAFTIQAAAGTLKEVL

SEQ ID NO: 54796 - protein, 283 aa, Homo sapiens
  Payload ID: 10823
  Gene Symbol: NAALAD2
  Gene Name: N-acetylated alpha-linked acidic dipeptidase 2
  ENSP ID: ENSP00000433710
MAESRGRLYLWMCLAAALASFLMGFMVGWFIKPLKETTTSVRYHQSIRWKLVSEMKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKATWEELLHQIRVGREPLM

SEQ ID NO: 54797 - protein, 372 aa, Homo sapiens
  Payload ID: 10823
  Gene Symbol: NAALAD2
  Gene Name: N-acetylated alpha-linked acidic dipeptidase 2
  ENSP ID: ENSP00000435249
MAESRGRLYLWMCLAAALASFLMGFMVGWFIKPLKETTTSVRYHQSIRWKLVSEMKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKDRYVILGGHRDSWVFGAIDPTSGVAVLQEIARSFGKLMSKGWRPRRTIIFASWDAEEFGLLGSTEWAEVNKTKKVLIIFLVNREQICMCLRMIKNIFHYLIWFCFGE

SEQ ID NO: 54798 - protein, 107 aa, Homo sapiens
  Payload ID: 10823
  Gene Symbol: NAALAD2
  Gene Name: N-acetylated alpha-linked acidic dipeptidase 2
  ENSP ID: ENSP00000435670
MKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPE

SEQ ID NO: 54799 - protein, 739 aa, Homo sapiens
  Payload ID: 10824
  Gene Symbol: NAALADL1
  Gene Name: N-acetylated alpha-linked acidic dipeptidase-like 1
  ENSP ID: ENSP00000340111
MQWTKVLGLGLGAAALLGLGIILGHFAIPKKANSLAPQDLDLEILETVMGQLDAHRIRENLRELSREPHLASSPRDEDLVQLLLQRWKDPESGLDSAEASTYEVLLSFPSQEQPNVVDIVGPTGGIIHSCHRTEENVTGEQGGPDVVQPYAAYAPSGTPQGLLVYANRGAEEDFKELQTQGIKLEGTIALTRYGGVGRGAKAVNAAKHGVAGVLVYTDPADINDGLSSPDETFPNSWYLPPSGVERGSYYEYFGDPLTPYLPAVPSSFRVDLANVSGFPPIPTQPIGFQDARDLLCNLNGTLAPATWQGALGCHYRLGPGFRPDGDFPADSQVNVSVYNRLELRNSSNVLGIIRGAVEPDRYVLYGNHRDSWVHGAVDPSSGTAVLLELSRVLGTLLKKGTWRPRRSIVFASWGAEEFGLIGSTEFTEEFFNKLQERTVAYINVDISVFANATLRVQGTPPVQSVVFSATKEIRSPGPGDLSIYDNWIRYFNRSSPVYGLVPSLGSLGAGSDYAPFVHFLGISSMDIAYTYDRSKTSARIYPTYHTAFDTFDYVDKFLDPGFSSHQAVARTAGSVILRLSDSFFLPLKVSDYSETLRSFLQAAQQDLGALLEQHSISLGPLVTAVEKFEAEAAALGQRISTLQKGSPDPLQVRMLNDQLMLLERTFLNPRAFPEERYYSHVLWAPRGLRSHIPGLSNACSRARDTASGSEAWAEVQRQLSIVVTALEGAAATLRPVADL

SEQ ID NO: 54800 - protein, 791 aa, Homo sapiens
  Payload ID: 10824
  Gene Symbol: NAALADL1
  Gene Name: N-acetylated alpha-linked acidic dipeptidase-like 1
  Uniprot ID: Q9UQQ1
  ENSP ID: ENSP00000344244
MQWTKVLGLGLGAAALLGLGIILGHFAIPKKANSLAPQDLDLEILETVMGQLDAHRIRENLRELSREPHLASSPRDEDLVQLLLQRWKDPESGLDSAEASTYEVLLSFPSQEQPNVVDIVGPTGGIIHSCHRTEENVTGEQGGPDVVQPYAAYAPSGTPQGLLVYANRGAEEDFKELQTQGIKLEGTIALTRYGGVGRGAKAVNAAKHGVAGVLVYTDPADINDGLSSPDETFPNSWYLPPSGVERGSYYEYFGDPLTPYLPAVPSSFRVDLANVSGFPPIPTQPIGFQDARDLLCNLNGTLAPATWQGALGCHYRLGPGFRPDGDFPADSQVNVSVYNRLELRNSSNVLGIIRGAVEPGEPSSCCLHPRPLLCSGCRCPHPALPLPPPSPAPPAHLSLSSGSLPLFLWPDRYVLYGNHRDSWVHGAVDPSSGTAVLLELSRVLGTLLKKGTWRPRRSIVFASWGAEEFGLIGSTEFTEEFFNKLQERTVAYINVDISVFANATLRVQGTPPVQSVVFSATKEIRSPGPGDLSIYDNWIRYFNRSSPVYGLVPSLGSLGAGSDYAPFVHFLGISSMDIAYTYDRSKTSARIYPTYHTAFDTFDYVDKFLDPGFSSHQAVARTAGSVILRLSDSFFLPLKVSDYSETLRSFLQAAQQDLGALLEQHSISLGPLVTAVEKFEAEAAALGQRISTLQKGSPDPLQVRMLNDQLMLLERTFLNPRAFPEERYYSHVLWAPRTGSVVTFPGLSNACSRARDTASGSEAWAEVQRQLSIVVTALEGAAATLRPVADL

SEQ ID NO: 54801 - protein, 699 aa, Homo sapiens
  Payload ID: 10824
  Gene Symbol: NAALADL1
  Gene Name: N-acetylated alpha-linked acidic dipeptidase-like 1
  Uniprot ID: Q9UQQ1
  ENSP ID: ENSP00000347955
MQWTKVLGLGLGAAALLGLGIILGHFAIPKKANSLAPQDLDLEILETVMGQLDAHRIRENLRELSREPHLASSPRDEDLVQLLLQRWKDPESGLDSAEASTYEVLLSFPSQEQPNVVDIVGPTGGIIHSCHRTEENVTGEQGGPDVVQPYAAYAPSGTPQAVNAAKHGVAGVLVYTDPADINDGLSSPDETFPNSWYLPPSGVERGSYYEYFGDPLTPYLPAVPSSFRVDLANVSGFPPIPTQPIGFQDARDLLCNLNGTLAPATWQGALGCHYRLGPGFRPDGDFPADSQVNVSVYNRLELRNSSNVLGIIRGAVEPDRYVLYGNHRDSWVHGAVDPSSGTAVLLELSRVLGTLLKKGTWRPRRSIVFASWGAEEFGLIGSTEFTEEFFNKLQERTVAYINVDISVFANATLRVQGTPPVQSVVFSATKEIRSPGPGDLSIYDNWIRYFNRSSPVYGLVPSLGSLGAGSDYAPFVHFLGISSMDIAYTYDRSKTSARIYPTYHTAFDTFDYVDKFLDPGFSSHQAVARTAGSVILRLSDSFFLPLKVSDYSETLRSFLQAAQQDLGALLEQHSISLGPLVTAVEKFEAEAAALGQRISTLQKGSPDPLQVRMLNDQLMLLERTFLNPRAFPEERYYSHVLWAPRTGSVVTFPGLSNACSRARDTASGSEAWAEVQRQLSIVVTALEGAAATLRPVADL

SEQ ID NO: 54802 - protein, 705 aa, Homo sapiens
  Payload ID: 10824
  Gene Symbol: NAALADL1
  Gene Name: N-acetylated alpha-linked acidic dipeptidase-like 1
  ENSP ID: ENSP00000349045
MQWTKVLGLGLGAAALLGLGIILGHFAIPKKANSLAPQDLDLEILETVMGQLDAHRIRENLRELSREPHLASSPRDEDLVQLLLQRWKDPESGLDSAEASTYEVLLSFPSQEQPNVVDIVGPTGGIIHSCHRTEENVTGEQGGPDVVQPYAAYAPSGTPQGLLVYANRGAEEDFKELQTQGIKLEGTIALTRYGGVGRGAKAVNAAKHGVAGVLVYTDPADINDGLSSPDETFPNSWYLPPSGVERGSYYEYFGDPLTPYLPAVPSSFRVDLANVSGFPPIPTQPIGFQDARDLLCQVNVSVYNRLELRNSSNVLGIIRGAVEPDRYVLYGNHRDSWVHGAVDPSSGTAVLLELSRVLGTLLKKGTWRPRRSIVFASWGAEEFGLIGSTEFTEEFFNKLQERTVAYINVDISVFANATLRVQGTPPVQSVVFSATKEIRSPGPGDLSIYDNWIRYFNRSSPVYGLVPSLGSLGAGSDYAPFVHFLGISSMDIAYTYDRSKTSARIYPTYHTAFDTFDYVDKFLDPGFSSHQAVARTAGSVILRLSDSFFLPLKVSDYSETLRSFLQAAQQDLGALLEQHSISLGPLVTAVEKFEAEAAALGQRISTLQKGSPDPLQVRMLNDQLMLLERTFLNPRAFPEERYYSHVLWAPRTGSVVTFPGLSNACSRARDTASGSEAWAEVQRQLSIVVTALEGAAATLRPVADL

SEQ ID NO: 54803 - protein, 740 aa, Homo sapiens
  Payload ID: 10824
  Gene Symbol: NAALADL1
  Gene Name: N-acetylated alpha-linked acidic dipeptidase-like 1
  Uniprot ID: Q9UQQ1
  ENSP ID: ENSP00000351484
MQWTKVLGLGLGAAALLGLGIILGHFAIPKKANSLAPQDLDLEILETVMGQLDAHRIRENLRELSREPHLASSPRDEDLVQLLLQRWKDPESGLDSAEASTYEVLLSFPSQEQPNVVDIVGPTGGIIHSCHRTEENVTGEQGGPDVVQPYAAYAPSGTPQGLLVYANRGAEEDFKELQTQGIKLEGTIALTRYGGVGRGAKAVNAAKHGVAGVLVYTDPADINDGLSSPDETFPNSWYLPPSGVERGSYYEYFGDPLTPYLPAVPSSFRVDLANVSGFPPIPTQPIGFQDARDLLCNLNGTLAPATWQGALGCHYRLGPGFRPDGDFPADSQVNVSVYNRLELRNSSNVLGIIRGAVEPDRYVLYGNHRDSWVHGAVDPSSGTAVLLELSRVLGTLLKKGTWRPRRSIVFASWGAEEFGLIGSTEFTEEFFNKLQERTVAYINVDISVFANATLRVQGTPPVQSVVFSATKEIRSPGPGDLSIYDNWIRYFNRSSPVYGLVPSLGSLGAGSDYAPFVHFLGISSMDIAYTYDRSKTSARIYPTYHTAFDTFDYVDKFLDPGFSSHQAVARTAGSVILRLSDSFFLPLKVSDYSETLRSFLQAAQQDLGALLEQHSISLGPLVTAVEKFEAEAAALGQRISTLQKGSPDPLQVRMLNDQLMLLERTFLNPRAFPEERYYSHVLWAPRTGSVVTFPGLSNACSRARDTASGSEAWAEVQRQLSIVVTALEGAAATLRPVADL

SEQ ID NO: 54804 - protein, 61 aa, Homo sapiens
  Payload ID: 10824
  Gene Symbol: NAALADL1
  Gene Name: N-acetylated alpha-linked acidic dipeptidase-like 1
  ENSP ID: ENSP00000431322
MLNDQLMLLERTFLNPRAFPEERYYSHVLWAPRTGSVVTFPGLSNACSRARDTASGSEAWA

SEQ ID NO: 54805 - protein, 26 aa, Homo sapiens
  Payload ID: 10824
  Gene Symbol: NAALADL1
  Gene Name: N-acetylated alpha-linked acidic dipeptidase-like 1
  ENSP ID: ENSP00000431513
MLNDQLMLLERTFLNPRAFPEERYYR

SEQ ID NO: 54806 - protein, 87 aa, Homo sapiens
  Payload ID: 10824
  Gene Symbol: NAALADL1
  Gene Name: N-acetylated alpha-linked acidic dipeptidase-like 1
  ENSP ID: ENSP00000431977
MLNDQLMLLERTFLNPRAFPEERYYSHVLWAPRTGSVVTFPGLSNACSRARDTASGSEAWAEVQRQLSIVVTALEGAAATLRPVADL

SEQ ID NO: 54807 - protein, 77 aa, Homo sapiens
  Payload ID: 10824
  Gene Symbol: NAALADL1
  Gene Name: N-acetylated alpha-linked acidic dipeptidase-like 1
  ENSP ID: ENSP00000433538
MLNDQLMLLERTFLNPRAFPEERYYSHVLWAPRTGSVVTFPGLSNACSRARDTASGSEAWAEVQRQLSIVVTALEGA

SEQ ID NO: 54808 - protein, 27 aa, Homo sapiens
  Payload ID: 10824
  Gene Symbol: NAALADL1
  Gene Name: N-acetylated alpha-linked acidic dipeptidase-like 1
  ENSP ID: ENSP00000433892
MLNDQLMLLERTFLNPRAFPEERYYSH

SEQ ID NO: 54809 - protein, 98 aa, Homo sapiens
  Payload ID: 10824
  Gene Symbol: NAALADL1
  Gene Name: N-acetylated alpha-linked acidic dipeptidase-like 1
  ENSP ID: ENSP00000434225
ETLRSFLQAAQQDLGALLEQHSISLGPLVTAVEKFEAEAAALGQRISTLQKGSPDPLQVRMLNDQLMLLERTFLNPRAFPEERYYSPPFTPTLSCLLS

SEQ ID NO: 54810 - protein, 70 aa, Homo sapiens
  Payload ID: 10824
  Gene Symbol: NAALADL1
  Gene Name: N-acetylated alpha-linked acidic dipeptidase-like 1
  ENSP ID: ENSP00000434233
MDIAYTYDRSKTSARIYPTYHTAFDTFDYVDKFLDPGFSSHQAVARTAGSVILRLSDSFFLPLKVSDYSE

SEQ ID NO: 54811 - protein, 74 aa, Homo sapiens
  Payload ID: 10824
  Gene Symbol: NAALADL1
  Gene Name: N-acetylated alpha-linked acidic dipeptidase-like 1
  ENSP ID: ENSP00000435267
MLNDQLMLLERTFLNPRAFPEERYYSHVLWAPRTGSVVTFPGLSNACSRARDTASGSEAWAEVQRQLSIVVTAL

SEQ ID NO: 54812 - protein, 35 aa, Homo sapiens
  Payload ID: 10824
  Gene Symbol: NAALADL1
  Gene Name: N-acetylated alpha-linked acidic dipeptidase-like 1
  ENSP ID: ENSP00000435549
MLNDQLMLLERTFLNPRAFPEERYYSHVLWAPRTG

SEQ ID NO: 54813 - protein, 48 aa, Homo sapiens
  Payload ID: 10824
  Gene Symbol: NAALADL1
  Gene Name: N-acetylated alpha-linked acidic dipeptidase-like 1
  ENSP ID: ENSP00000435917
SPGPGDLSIYDNWIRYFNRSSPVYGLVPRLQQPSGCGPDSGECDSPAQ

SEQ ID NO: 54814 - protein, 54 aa, Homo sapiens
  Payload ID: 10825
  Gene Symbol: NAALADL2
  Gene Name: N-acetylated alpha-linked acidic dipeptidase-like 2
  ENSP ID: ENSP00000396969
AEVIDVSYGMADDLKRIRKIKNVTNQIALLKLGKLPLLYKMKVLDKADQTSPLY

SEQ ID NO: 54815 - protein, 795 aa, Homo sapiens
  Payload ID: 10825
  Gene Symbol: NAALADL2
  Gene Name: N-acetylated alpha-linked acidic dipeptidase-like 2
  Uniprot ID: Q58DX5
  ENSP ID: ENSP00000404705
MGENEASLPNTSLQGKKMAYQKVHADQRAPGHSQYLDNDDLQATALDLEWDMEKELEESGFDQFQLDGAENQNLGHSETIDLNLDSIQPATSPKGRFQRLQEESDYITHYTRSAPKSNRCNFCHVLKILCTATILFIFGILIGYYVHTNCPSDAPSSGTVDPQLYQEILKTIQAEDIKKSFRNLVQLYKNEDDMEISKKIKTQWTSLGLEDVQFVNYSVLLDLPGPSPSTVTLSSSGQCFHPNGQPCSEEARKDSSQDLLYSYAAYSAKGTLKAEVIDVSYGMADDLKRIRKIKNVTNQIALLKLGKLPLLYKLSSLEKAGFGGVLLYIDPCDLPKTVNPSHDTFMVSLNPGGDPSTPGYPSVDESFRQSRSNLTSLLVQPISAPLVAKLISSPKARTKNEACSSLELPNNEIRVVSMQVQTVTKLKTVTNVVGFVMGLTSPDRYIIVGSHHHTAHSYNGQEWASSTAIITAFIRALMSKVKRGWRPDRTIVFCSWGGTAFGNIGSYEWGEDFKKVLQKNVVAYISLHSPIRGNSSLYPVASPSLQQLVVEKNNFNCTRRAQCPETNISSIQIQGDADYFINHLGVPIVQFAYEDIKTLEGPSFLSEARFSTRATKIEEMDPSFNLHETITKLSGEVILQIANEPVLPFNALDIALEVQNNLKGDQPNTHQLLAMALRLRESAELFQSDEMRPANDPKERAPIRIRMLNDILQDMEKSFLVKQAPPGFYRNILYHLDEKTSRFSILIEAWEHCKPLASNETLQEALSEVLNSINSAQVYFKAGLDVFKSVLDGKN

SEQ ID NO: 54816 - protein, 115 aa, Homo sapiens
  Payload ID: 10825
  Gene Symbol: NAALADL2
  Gene Name: N-acetylated alpha-linked acidic dipeptidase-like 2
  ENSP ID: ENSP00000409858
MAYQKVHADQRAPGHSQYLDNDDLQATALDLEWDMEKELEESGFDQFQLDGAENQNLGHSETIDLNLDSIQPATSPKGRFQRLQEESDYITHYTRSAPKSNRCNFCHVLKILCTA

SEQ ID NO: 54817 - protein, 783 aa, Homo sapiens
  Payload ID: 10825
  Gene Symbol: NAALADL2
  Gene Name: N-acetylated alpha-linked acidic dipeptidase-like 2
  ENSP ID: ENSP00000479989
FTGKKMAYQKVHADQRAPGHSQYLDNDDLQATALDLEWDMEKELEESGFDQFQLDGAENQNLGHSETIDLNLDSIQPATSPKGRFQRLQEESDYITHYTRSAPKSNRCNFCHVLKILCTATILFIFGILIGYYVHTNCPSDAPSSGTVDPQLYQEILKTIQAEDIKKSFRNLVQLYKNEDDMEISKKIKTQWTSLGLEDVQFVNYSVLLDLPGPSPSTVTLSSSGQCFHPNGQPCSEEARKDSSQDLLYSYAAYSAKGTLKAEVIDVSYGMADDLKRIRKIKNVTNQIALLKLGKLPLLYKLSSLEKAGFGGVLLYIDPCDLPKTVNPSHDTFMVSLNPGGDPSTPGYPSVDESFRQSRSNLTSLLVQPISAPLVAKLISSPKARTKNEACSSLELPNNEIRVVSMQVQTVTKLKTVTNVVGFVMGLTSPDRYIIVGSHHHTAHSYNGQEWASSTAIITAFIRALMSKVKRGWRPDRTIVFCSWGGTAFGNIGSYEWGEDFKKVLQKNVVAYISLHSPIRGNSSLYPVASPSLQQLVVEKNNFNCTRRAQCPETNISSIQIQGDADYFINHLGVPIVQFAYEDIKTLEGPSFLSEARFSTRATKIEEMDPSFNLHETITKLSGEVILQIANEPVLPFNALDIALEVQNNLKGDQPNTHQLLAMALRLRESAELFQSDEMRPANDPKERAPIRIRMLNDILQDMEKSFLVKQAPPGFYRNILYHLDEKTSRFSILIEAWEHCKPLASNETLQEALSEVLNSINSAQVYFKAGLDVFKSVLDGKN

SEQ ID NO: 54818 - protein, 411 aa, Homo sapiens
  Payload ID: 10826
  Gene Symbol: NAGA
  Gene Name: N-acetylgalactosaminidase, alpha-
  Uniprot ID: P17050
  ENSP ID: ENSP00000379680
MLLKTVLLLGHVAQVLMLDNGLLQTPPMGWLAWERFRCNINCDEDPKNCISEQLFMEMADRMAQDGWRDMGYTYLNIDDCWIGGRDASGRLMPDPKRFPHGIPFLADYVHSLGLKLGIYADMGNFTCMGYPGTTLDKVVQDAQTFAEWKVDMLKLDGCFSTPEERAQGYPKMAAALNATGRPIAFSCSWPAYEGGLPPRVNYSLLADICNLWRNYDDIQDSWWSVLSILNWFVEHQDILQPVAGPGHWNDPDMLLIGNFGLSLEQSRAQMALWTVLAAPLLMSTDLRTISAQNMDILQNPLMIKINQDPLGIQGRRIHKEKSLIEVYMRPLSNKASALVFFSCRTDMPYRYHSSLGQLNFTGSVIYEAQDVYSGDIISGLRDETNFTVIINPSGVVMWYLYPIKNLEMSQQ

SEQ ID NO: 54819 - protein, 411 aa, Homo sapiens; identical to SEQ ID NO: 54818
  Payload ID: 10826
  Gene Symbol: NAGA
  Gene Name: N-acetylgalactosaminidase, alpha-
  Uniprot ID: P17050
  ENSP ID: ENSP00000384603

SEQ ID NO: 54820 - protein, 411 aa, Homo sapiens; identical to SEQ ID NO: 54818
  Payload ID: 10826
  Gene Symbol: NAGA
  Gene Name: N-acetylgalactosaminidase, alpha-
  Uniprot ID: P17050
  ENSP ID: ENSP00000385283

SEQ ID NO: 54821 - protein, 344 aa, Homo sapiens
  Payload ID: 10827
  Gene Symbol: NAGK
  Gene Name: N-acetylglucosamine kinase
  Uniprot ID: Q9UJ70
  ENSP ID: ENSP00000244204
MAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 54822 - protein, 390 aa, Homo sapiens
  Payload ID: 10827
  Gene Symbol: NAGK
  Gene Name: N-acetylglucosamine kinase
  Uniprot ID: Q9UJ70
  ENSP ID: ENSP00000389087
MRTRTGSQLAAREVTGSGAVPRQLEGRRCQAGRDANGGTSSDGSSSMAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 54823 - protein, 293 aa, Homo sapiens
  Payload ID: 10827
  Gene Symbol: NAGK
  Gene Name: N-acetylglucosamine kinase
  ENSP ID: ENSP00000396070
MVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 54824 - protein, 159 aa, Homo sapiens
  Payload ID: 10827
  Gene Symbol: NAGK
  Gene Name: N-acetylglucosamine kinase
  ENSP ID: ENSP00000400941
MAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSALAH

SEQ ID NO: 54825 - protein, 196 aa, Homo sapiens
  Payload ID: 10827
  Gene Symbol: NAGK
  Gene Name: N-acetylglucosamine kinase
  ENSP ID: ENSP00000404531
MMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 54826 - protein, 59 aa, Homo sapiens
  Payload ID: 10827
  Gene Symbol: NAGK
  Gene Name: N-acetylglucosamine kinase
  ENSP ID: ENSP00000408550
MRTRTGSQLAAREVTGSGAVPRQLEGRRCQAGRDANGGTSSDGSSSMAAIYGGVEGAYL

SEQ ID NO: 54827 - protein, 340 aa, Homo sapiens
  Payload ID: 10827
  Gene Symbol: NAGK
  Gene Name: N-acetylglucosamine kinase
  ENSP ID: ENSP00000411846
MAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPGKIGLPILCVGSVWKSWELLKEGFLLALTQGREIQAQNFFSSFTLMKLRHSSALGGASLGARHIGHLLPMDYSANAIAFYSYTFS

SEQ ID NO: 54828 - protein, 136 aa, Homo sapiens
  Payload ID: 10827
  Gene Symbol: NAGK
  Gene Name: N-acetylglucosamine kinase
  ENSP ID: ENSP00000431204
DAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRCSAGRPPFPLYLQEGWGDAGQTHRSSVARD

SEQ ID NO: 54829 - protein, 84 aa, Homo sapiens
  Payload ID: 10827
  Gene Symbol: NAGK
  Gene Name: N-acetylglucosamine kinase
  ENSP ID: ENSP00000435207
MVNRAKRKAGVDPLVPLRSLGLSLSGGDQEDAGRILIEELRDRFPYLSESYLITTDAAGSIATATPDGGVVLISGTGSNCRLIN

SEQ ID NO: 54830 - protein, 182 aa, Homo sapiens
  Payload ID: 10827
  Gene Symbol: NAGK
  Gene Name: N-acetylglucosamine kinase
  ENSP ID: ENSP00000435437
  MOD_RES (1)..(1): Any amino acid
XSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQIG

SEQ ID NO: 54831 - protein, 94 aa, Homo sapiens
  Payload ID: 10827
  Gene Symbol: NAGK
  Gene Name: N-acetylglucosamine kinase
  ENSP ID: ENSP00000436326
MMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEML

SEQ ID NO: 54832 - protein, 109 aa, Homo sapiens
  Payload ID: 10827
  Gene Symbol: NAGK
  Gene Name: N-acetylglucosamine kinase
  ENSP ID: ENSP00000437192
  MOD_RES (1)..(1): Any amino acid
XEAAPHDIGYVKQAMFHYFQVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 54833 - protein, 390 aa, Homo sapiens; identical to SEQ ID NO: 54822
  Payload ID: 10827
  Gene Symbol: NAGK
  Gene Name: N-acetylglucosamine kinase
  Uniprot ID: Q9UJ70
  ENSP ID: ENSP00000477639

SEQ ID NO: 54834 - protein, 1256 aa, Homo sapiens
  Payload ID: 10828
  Gene Symbol: GNPTAB
  Gene Name: N-acetylglucosamine-1-phosphate transferase, alpha and beta subunits
  Uniprot ID: Q3T906
  ENSP ID: ENSP00000299314
MLFKLLQRQTYTCLSHRYGLYVCFLGVVVTIVSAFQFGEVVLEWSRDQYHVLFDSYRDNIAGKSFQNRLCLPMPIDVVYTWVNGTDLELLKELQQVREQMEEEQKAMREILGKNTTEPTKKSEKQLECLLTHCIKVPMLVLDPALPANITLKDLPSLYPSFHSASDIFNVAKPKNPSTNVSVVVFDSTKDVEDAHSGLLKGNSRQTVWRGYLTTDKEVPGLVLMQDLAFLSGFPPTFKETNQLKTKLPENLSSKVKLLQLYSEASVALLKLNNPKDFQELNKQTKKNMTIDGKELTISPAYLLWDLSAISQSKQDEDISASRFEDNEELRYSLRSIERHAPWVRNIFIVTNGQIPSWLNLDNPRVTIVTHQDVFRNLSHLPTFSSPAIESHIHRIEGLSQKFIYLNDDVMFGKDVWPDDFYSHSKGQKVYLTWPVPNCAEGCPGSWIKDGYCDKACNNSACDWDGGDCSGNSGGSRYIAGGGGTGSIGVGQPWQFGGGINSVSYCNQGCANSWLADKFCDQACNVLSCGFDAGDCGQDHFHELYKVILLPNQTHYIIPKGECLPYFSFAEVAKRGVEGAYSDNPIIRHASIANKWKTIHLIMHSGMNATTIHFNLTFQNTNDEEFKMQITVEVDTREGPKLNSTAQKGYENLVSPITLLPEAEILFEDIPKEKRFPKFKRHDVNSTRRAQEEVKIPLVNISLLPKDAQLSLNTLDLQLEHGDITLKGYNLSKSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQMTKEKKITGKEKENSRMEENAENHIGVTEVLLGRKLQHYTDSYLGFLPWEKKKYFQDLLDEEESLKTQLAYFTDSKNTGRQLKDTFADSLRYVNKILNSKFGFTSRKVPAHMPHMIDRIVMQELQDMFPEEFDKTSFHKVRHSEDMQFAFSYFYYLMSAVQPLNISQVFDEVDTDQSGVLSDREIRTLATRIHELPLSLQDLTGLEHMLINCSKMLPADITQLNNIPPTQESYYDPNLPPVTKSLVTNCKPVTDKIHKAYKDKNKYRFEIMGEEEIAFKMIRTNVSHVVGQLDDIRKNPRKFVCLNDNIDHNHKDAQTVKAVLRDFYESMFPIPSQFELPREYRNRFLHMHELQEWRAYRDKLKFWTHCVLATLIMFTIFSFFAEQLIALKRKIFPRRRIHKEASPNRIRV

SEQ ID NO: 54835 - protein, 71 aa, Homo sapiens
  Payload ID: 10828
  Gene Symbol: GNPTAB
  Gene Name: N-acetylglucosamine-1-phosphate transferase, alpha and beta subunits
  ENSP ID: ENSP00000376651
MLFKLLQRQTYTCLSHRYGLYVCFLGVVVTIVSAFQFGEVVLEWSRDQYHVLFDSYRDNIAGKSFQNRSVR

SEQ ID NO: 54836 - protein, 490 aa, Homo sapiens
  Payload ID: 10828
  Gene Symbol: GNPTAB
  Gene Name: N-acetylglucosamine-1-phosphate transferase, alpha and beta subunits
  Uniprot ID: Q3T906
  ENSP ID: ENSP00000449150
MLFKLLQRQTYTCLSHRYGLYVCFLGVVVTIVSAFQFGEVVLEWSRDQYHVLFDSYRDNIAGKSFQNRLCLPMPIDVVYTWVNGTDLELLKELQQVREQMEEEQKAMREILGKNTTEPTKKSEKQLECLLTHCIKVPMLVLDPALPANITLKDLPSLYPSFHSASDIFNVAKPKNPSTNVSVVVFDSTKDVEDAHSGLLKGNSRQTVWRGYLTTDKEVPGLVLMQDLAFLSGFPPTFKETNQLKTKLPENLSSKVKLLQLYSEASVALLKLNNPKDFQELNKQTKKNMTIDGKELTISPAYLLWDLSAISQSKQDEDISASRFEDNEELRYSLRSIERHAPWVRNIFIVTNGQIPSWLNLDNPRVTIVTHQDVFRNLSHLPTFSSPAIESHIHRIEGLSQKFIYLNDDVMFGKDVWPDDFYSHSKGQKVYLTWPVPNCAEGCPGSWIKDGYCDKACNNSACDWDGGDCSGKDVLNCNSFIFMEYFLLNHY

SEQ ID NO: 54837 - protein, 138 aa, Homo sapiens
  Payload ID: 10828
  Gene Symbol: GNPTAB
  Gene Name: N-acetylglucosamine-1-phosphate transferase, alpha and beta subunits
  ENSP ID: ENSP00000449217
EKQLECLLTHCIKVPMLVLDPALPANITLKDLPSLYPSFHSASDIFNVAKPKNPSTNVSVVVFDSTKDVEDAHSGLLKGNSRQTVWRGYLTTDKEVPGLVLMQDLAFLSGFPPTFKETNQLKTKLPENLSSKVKLVRT

SEQ ID NO: 54838 - protein, 117 aa, Homo sapiens
  Payload ID: 10828
  Gene Symbol: GNPTAB
  Gene Name: N-acetylglucosamine-1-phosphate transferase, alpha and beta subunits
  ENSP ID: ENSP00000449557
  MOD_RES (1)..(1): Any amino acid
XDITQLNNIPPTQESYYDPNLPPVTKSLVTNCKPVTDKIHKAYKDKNKYRFEIMGEEEIAFKMIRTNVSHVVGQLDDIRKNPRISLCCPSWNAVMQTWLTVASTSWAQAILPPQPPD

SEQ ID NO: 54839 - protein, 96 aa, Homo sapiens
  Payload ID: 10828
  Gene Symbol: GNPTAB
  Gene Name: N-acetylglucosamine-1-phosphate transferase, alpha and beta subunits
  ENSP ID: ENSP00000450161
PPVTKSLVTNCKPVTDKIHKAYKDKNKYRFEIMGEEEIAFKMIRTNVSHVVGQLDDIRKNPRISLCCPSWNAVMQTWLTVASTSWAQAILPPQPPD

SEQ ID NO: 54840 - protein, 68 aa, Homo sapiens
  Payload ID: 10828
  Gene Symbol: GNPTAB
  Gene Name: N-acetylglucosamine-1-phosphate transferase, alpha and beta subunits
  ENSP ID: ENSP00000450413
MLFKLLQRQTYTCLSHRYGLYVCFLGVVVTIVSAFQFGEVVLEWSRDQYHVLFDSYRDNIAGKSFQNR

SEQ ID NO: 54841 - protein, 305 aa, Homo sapiens
  Payload ID: 10829
  Gene Symbol: GNPTG
  Gene Name: N-acetylglucosamine-1-phosphate transferase, gamma subunit
  Uniprot ID: Q9UJJ9
  ENSP ID: ENSP00000204679
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 54842 - protein, 76 aa, Homo sapiens
  Payload ID: 10829
  Gene Symbol: GNPTG
  Gene Name: N-acetylglucosamine-1-phosphate transferase, gamma subunit
  ENSP ID: ENSP00000434413
MAAGLARLLLLLGLSAGGPAPAGAAKMKVVEEPNAFGVNNPFLPQASRLQAKRDPSPVSETGFHRVSQDGLDLLTS

SEQ ID NO: 54843 - protein, 184 aa, Homo sapiens
  Payload ID: 10829
  Gene Symbol: GNPTG
  Gene Name: N-acetylglucosamine-1-phosphate transferase, gamma subunit
  ENSP ID: ENSP00000435349
  MOD_RES (1)..(1): Any amino acid
XRLLLLLGLSAGGEWPGRPRPQAPRALCTPASPLTVSLPVGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYAL

SEQ ID NO: 54844 - protein, 76 aa, Homo sapiens; identical to SEQ ID NO: 54842
  Payload ID: 10829
  Gene Symbol: GNPTG
  Gene Name: N-acetylglucosamine-1-phosphate transferase, gamma subunit
  ENSP ID: ENSP00000460728

SEQ ID NO: 54845 - protein, 61 aa, Homo sapiens
  Payload ID: 10829
  Gene Symbol: GNPTG
  Gene Name: N-acetylglucosamine-1-phosphate transferase, gamma subunit
  ENSP ID: ENSP00000480060
MAAGLARLLLLLGLSAGGPAPAGAAKMKVVEEPNAFGVNNPFLPQASRLQAKRDPSPVSGE

SEQ ID NO: 54846 - protein, 515 aa, Homo sapiens
  Payload ID: 10830
  Gene Symbol: NAGPA
  Gene Name: N-acetylglucosamine-1-phosphodiester alpha-N-acetylglucosaminidase
  Uniprot ID: Q9UK23
  ENSP ID: ENSP00000310998
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHCQDNMWRCPRQVSTVVCVHEPRCQPPDCHGHGTCVDGHCQCTGHFWRGPGCDELDCGPSNCSQHGLCTETGCRCDAGWTGSNCSEECPLGWHGPGCQRPCKCEHHCPCDPKTGNCSVSRVKQCLQPPEATLRAGELSFFTRTAWLALTLALAFLLLISTAANLSLLLSRAERNRRLHGDYAYHPLQEMNGEPLAAEKEQPGGAHNPFKD

SEQ ID NO: 54847 - protein, 481 aa, Homo sapiens
  Payload ID: 10830
  Gene Symbol: NAGPA
  Gene Name: N-acetylglucosamine-1-phosphodiester alpha-N-acetylglucosaminidase
  Uniprot ID: Q9UK23
  ENSP ID: ENSP00000371381
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHCQDNMWRCPRQVSTVVCVHEPRCQPPDCHGHGTCVDGHCQCTGHFWRGPGCDELDCGPSNCSQHGLCTETGCRCDAGWTGSNCSEVKQCLQPPEATLRAGELSFFTRTAWLALTLALAFLLLISTAANLSLLLSRAERNRRLHGDYAYHPLQEMNGEPLAAEKEQPGGAHNPFKD

SEQ ID NO: 54848 - protein, 309 aa, Homo sapiens
  Payload ID: 10830
  Gene Symbol: NAGPA
  Gene Name: N-acetylglucosamine-1-phosphodiester alpha-N-acetylglucosaminidase
  Uniprot ID: Q9UK23
  ENSP ID: ENSP00000455900
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHWQA

SEQ ID NO: 54849 - protein, 104 aa, Homo sapiens
  Payload ID: 10830
  Gene Symbol: NAGPA
  Gene Name: N-acetylglucosamine-1-phosphodiester alpha-N-acetylglucosaminidase
  ENSP ID: ENSP00000464994
NREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVPV

SEQ ID NO: 54850 - protein, 40 aa, Homo sapiens
  Payload ID: 10830
  Gene Symbol: NAGPA
  Gene Name: N-acetylglucosamine-1-phosphodiester alpha-N-acetylglucosaminidase
  ENSP ID: ENSP00000465523
  MOD_RES (1)..(1): Any amino acid
XSSSGGLQNAQFGIRRDGTLVTGMGIGIASLQSLFIIQYH

SEQ ID NO: 54851 - protein, 172 aa, Homo sapiens
  Payload ID: 10830
  Gene Symbol: NAGPA
  Gene Name: N-acetylglucosamine-1-phosphodiester alpha-N-acetylglucosaminidase
  ENSP ID: ENSP00000465949
VSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHCCSGGSGGRIAIPHLKNR

SEQ ID NO: 54852 - protein, 315 aa, Homo sapiens
  Payload ID: 10830
  Gene Symbol: NAGPA
  Gene Name: N-acetylglucosamine-1-phosphodiester alpha-N-acetylglucosaminidase
  ENSP ID: ENSP00000467385
  MOD_RES (1)..(1): Any amino acid
XESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHWTAWLALTLALAFLLLISTAANLSLLLSRAERNRRLHGDYAYHPLQEMNGEPLAAEKEQPGGAHNPFKD

SEQ ID NO: 54853 - protein, 190 aa, Homo sapiens
  Payload ID: 10830
  Gene Symbol: NAGPA
  Gene Name: N-acetylglucosamine-1-phosphodiester alpha-N-acetylglucosaminidase
  ENSP ID: ENSP00000468270
  MOD_RES (1)..(1): Any amino acid
XHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETARTTCGAVPAKCPPWCVCTNPA

SEQ ID NO: 54854 - protein, 743 aa, Homo sapiens
  Payload ID: 10831
  Gene Symbol: NAGLU
  Gene Name: N-acetylglucosaminidase, alpha
  Uniprot ID: P54802
  ENSP ID: ENSP00000225927
MEAVAVAAAVGVLLLAGAGGAAGDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 54855 - protein, 81 aa, Homo sapiens
  Payload ID: 10831
  Gene Symbol: NAGLU
  Gene Name: N-acetylglucosaminidase, alpha
  ENSP ID: ENSP00000466892
MGDLFQGRGPSRVGCAPAHDTARRYRYYQNVCTQSYSFVWWDWARWEREIDWMALNGINLALAWSGQEAIWQRVYLALGLT

SEQ ID NO: 54856 - protein, 170 aa, Homo sapiens
  Payload ID: 10831
  Gene Symbol: NAGLU
  Gene Name: N-acetylglucosaminidase, alpha
  ENSP ID: ENSP00000467135
  MOD_RES (1)..(1): Any amino acid
XGRRGAAPLPARLLWLPRGLVRLSAAPAAATASRAGGADRGHAQQVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKE

SEQ ID NO: 54857 - protein, 122 aa, Homo sapiens
  Payload ID: 10831
  Gene Symbol: NAGLU
  Gene Name: N-acetylglucosaminidase, alpha
  ENSP ID: ENSP00000467836
RGAAPLPARLLWLPRGLVRLSAAPAAATASRAGGADRGHAQQVYLALGLTQAEINEFFTGPAFLAWGRMGNLHTWDGPLPPSWHIKQLYLQHRVLDQMRSFGMTPVLPAFAGHVPEAVTSGY

SEQ ID NO: 54858 - protein, 65 aa, Homo sapiens
  Payload ID: 10831
  Gene Symbol: NAGLU
  Gene Name: N-acetylglucosaminidase, alpha
  ENSP ID: ENSP00000468665
  MOD_RES (1)..(1): Any amino acid
XFGTDHIYGADTFNEMQPPSSEPSYLAAATTAVYEAMTAVLGARPDQGCAGSCAPWPPPGSGPVC

SEQ ID NO: 54859 - protein, 534 aa, Homo sapiens
  Payload ID: 10832
  Gene Symbol: NAGS
  Gene Name: N-acetylglutamate synthase
  Uniprot ID: Q8N159
  ENSP ID: ENSP00000293404
MATALMAVVLRAAAVAPRLRGRGGTGGARRLSCGARRRAARGTSPGRRLSTAWSQPQPPPEEYAGADDVSQSPVAEEPSWVPSPRPPVPHESPEPPSGRSLVQRDIQAFLNQCGASPGEARHWLTQFQTCHHSADKPFAVIEVDEEVLKCQQGVSSLAFALAFLQRMDMKPLVVLGLPAPTAPSGCLSFWEAKAQLAKSCKVLVDALRHNAAAAVPFFGGGSVLRAAEPAPHASYGGIVSVETDLLQWCLESGSIPILCPIGETAARRSVLLDSLEVTASLAKALRPTKIIFLNNTGGLRDSSHKVLSNVNLPADLDLVCNAEWVSTKERQQMRLIVDVLSRLPHHSSAVITAASTLLTELFSNKGSGTLFKNAERMLRVRSLDKLDQGRLVDLVNASFGKKLRDDYLASLRPRLHSIYVSEGYNAAAILTMEPVLGGTPYLDKFVVSSSRQGQGSGQMLWECLRRDLQTLFWRSRVTNPINPWYFKHSDGSFSNKQWIFFWFGLADIRDSYELVNHAKGLPDSFHKPASDPGS

SEQ ID NO: 54860 - protein, 511 aa, Homo sapiens
  Payload ID: 10832
  Gene Symbol: NAGS
  Gene Name: N-acetylglutamate synthase
  ENSP ID: ENSP00000465408
SCGARRRAARGTSPGRRLSTAWSQPQPPPEEYAGADDVSQSPVAEEPSWVPSPRPPVPHESPEPPSGRSLVQRDIQAFLNQCGASPGEARHWLTQFQTCHHSADKPFAVIEVDEEVLKCQQGVSSLAFALAFLQRMDMKPLVVLGLPAPTAPSGCLSFWEAKAQLAKSCKVLVDALRHNAAAAVPFFGGGSVLRAAEPAPHASYGGIVSVETDLLQWCLESGSIPILCPIGETAARRSVLLDSLEVTASLAKALRPTKIIFLNNTGGLRDSSHKVLSNVNLPADLDLVCNAEWVSTKERQQMRLIVDVLSRLPHHSSAVITAASTLLTELFSNKGSGTLFKNAERMLRVRSLDKLDQGRLVDLVNASFGKKLRDDYLASLRPRLHSIYVSEGLPLSRCARYNAAAILTMEPVLGGTPYLDKFVVSSSRQGQGSGQMLWECLRRDLQTLFWRSRVTNPINPWYFKHSDGSFSNKQWIFFWFGLADIRDSYELVNHAKGLPDSFHKPASDPGS

SEQ ID NO: 54861 - protein, 320 aa, Homo sapiens
  Payload ID: 10833
  Gene Symbol: NPL
  Gene Name: N-acetylneuraminate pyruvate lyase (dihydrodipicolinate synthase)
  Uniprot ID: Q9BXD5
  ENSP ID: ENSP00000258317
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSTYNYLGKKTNQMLEAFEQKDFSLALNYQFCIQRFINFVVKLGFGVSQTKAIMTLVSGIPMGPPRLPLQKASREFTDSAEAKLKSLDFLSFTDLKDGNLEAGS

SEQ ID NO: 54862 - protein, 240 aa, Homo sapiens
  Payload ID: 10833
  Gene Symbol: NPL
  Gene Name: N-acetylneuraminate pyruvate lyase (dihydrodipicolinate synthase)
  Uniprot ID: Q9BXD5
  ENSP ID: ENSP00000356523
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEFCIQRFINFVVKLENSKLKVSKNQRTLPLGTTNFPFLH

SEQ ID NO: 54863 - protein, 320 aa, Homo sapiens; identical to SEQ ID NO: 54861
  Payload ID: 10833
  Gene Symbol: NPL
  Gene Name: N-acetylneuraminate pyruvate lyase (dihydrodipicolinate synthase)
  Uniprot ID: Q9BXD5
  ENSP ID: ENSP00000356524

SEQ ID NO: 54864 - protein, 301 aa, Homo sapiens
  Payload ID: 10833
  Gene Symbol: NPL
  Gene Name: N-acetylneuraminate pyruvate lyase (dihydrodipicolinate synthase)
  Uniprot ID: Q9BXD5
  ENSP ID: ENSP00000356525
MSRAPGILASWRRAPSLSVQKGSQTARHTCHPEVPLGNCFLPVYKASPLTVTRLWAERLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSTYNYLGKKTNQMLEAFEQKDFSLALNYQFCIQRFINFVVKLGFGVSQTKAIMTLVSGIPMGPPRLPLQKASREFTDSAEAKLKSLDFLSFTDLKDGNLEAGS

SEQ ID NO: 54865 - protein, 240 aa, Homo sapiens; identical to SEQ ID NO: 54862
  Payload ID: 10833
  Gene Symbol: NPL
  Gene Name: N-acetylneuraminate pyruvate lyase (dihydrodipicolinate synthase)
  Uniprot ID: Q9BXD5
  ENSP ID: ENSP00000356526

SEQ ID NO: 54866 - protein, 230 aa, Homo sapiens
  Payload ID: 10833
  Gene Symbol: NPL
  Gene Name: N-acetylneuraminate pyruvate lyase (dihydrodipicolinate synthase)
  ENSP ID: ENSP00000482415
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSFVSRDLSTLLSN

SEQ ID NO: 54867 - protein, 248 aa, Homo sapiens
  Payload ID: 10834
  Gene Symbol: NANP
  Gene Name: N-acetylneuraminic acid phosphatase
  Uniprot ID: Q8TBE9
  ENSP ID: ENSP00000302441
MGLSRVRAVFFDLDNTLIDTAGASRRGMLEVIKLLQSKYHYKEEAEIICDKVQVKLSKECFHPYNTCITDLRTSHWEEAIQETKGGAANRKLAEECYFLWKSTRLQHMTLAEDVKAMLTELRKEVRLLLLTNGDRQTQREKIEACACQSYFDAVVVGGEQREEKPAPSIFYYCCNLLGVQPGDCVMVGDTLETDIQGGLNAGLKATVWINKNGIVPLKSSPVPHYMVSSVLELPALLQSIDCKVSMST

SEQ ID NO: 54868 - protein, 359 aa, Homo sapiens
  Payload ID: 10835
  Gene Symbol: NANS
  Gene Name: N-acetylneuraminic acid synthase
  Uniprot ID: Q9NR45
  ENSP ID: ENSP00000210444
MPLELELCPGRWVGGQHPCFIIAEIGQNHQGDLDVAKRMIRMAKECGADCAKFQKSELEFKFNRKALERPYTSKHSWGKTYGEHKRHLEFSHDQYRELQRYAEEVGIFFTASGMDEMAVEFLHELNVPFFKVGSGDTNNFPYLEKTAKKGRPMVISSGMQSMDTMKQVYQIVKPLNPNFCFLQCTSAYPLQPEDVNLRVISEYQKLFPDIPIGYSGHETGIAISVAAVALGAKVLERHITLDKTWKGSDHSASLEPGELAELVRSVRLVERALGSPTKQLLPCEMACNEKLGKSVVAKVKIPEGTILTMDMLTVKVGEPKGYPPEDIFNLVGKKVLVTVEEDDTIMEELVDNHGKKIKS

SEQ ID NO: 54869 - protein, 140 aa, Homo sapiens
  Payload ID: 10835
  Gene Symbol: NANS
  Gene Name: N-acetylneuraminic acid synthase
  ENSP ID: ENSP00000404107
MVLVLDYSGRPMVISSGMQSMDTMKQVYQIVKPLNPNFCFLQCTSAYPLQPEDVNLRVISEYQKLFPDIPIGYSGHETGIAISVAAVALGAKVLERHITLDKTWKGSDHSASLEPGELAELVRSVRLVERALGSPTKQLL

SEQ ID NO: 54870 - protein, 115 aa, Homo sapiens
  Payload ID: 10835
  Gene Symbol: NANS
  Gene Name: N-acetylneuraminic acid synthase
  ENSP ID: ENSP00000404642
EDVNLRVISEYQKLFPDIPIGYSGHETGIAISVAAVALGAKVLERHITLDKTWKGSDHSASLEPGELAELVRSVRLVERALGSPTKQLLPCEMACNEKVCPAGLYSVLLPCVEKG

SEQ ID NO: 54871 - protein, 290 aa, Homo sapiens
  Payload ID: 10836
  Gene Symbol: NAT1
  Gene Name: N-acetyltransferase 1 (arylamine N-acetyltransferase)
  Uniprot ID: P18440
  ENSP ID: ENSP00000307218
MDIEAYLERIGYKKSRNKLDLETLTDILQHQIRAVPFENLNIHCGDAMDLGLEAIFDQVVRRNRGGWCLQVNHLLYWALTTIGFETTMLGGYVYSTPAKKYSTGMIHLLLQVTIDGRNYIVDAGFGRSYQMWQPLELISGKDQPQVPCVFRLTEENGFWYLDQIRREQYIPNEEFLHSDLLEDSKYRKIYSFTLKPRTIEDFESMNTYLQTSPSSVFTSKSFCSLQTPDGVHCLVGFTLTHRRFNYKDNTDLIEFKTLSEEEIEKVLKNIFNISLQRKLVPKHGDRFFTI

SEQ ID NO: 54872 - protein, 290 aa, Homo sapiens; identical to SEQ ID NO: 54871
  Payload ID: 10836
  Gene Symbol: NAT1
  Gene Name: N-acetyltransferase 1 (arylamine N-acetyltransferase)
  Uniprot ID: P18440
  ENSP ID: ENSP00000428270

SEQ ID NO: 54873 - protein, 290 aa, Homo sapiens; identical to SEQ ID NO: 54871
  Payload ID: 10836
  Gene Symbol: NAT1
  Gene Name: N-acetyltransferase 1 (arylamine N-acetyltransferase)
  Uniprot ID: P18440
  ENSP ID: ENSP00000429341

SEQ ID NO: 54874 - protein, 290 aa, Homo sapiens; identical to SEQ ID NO: 54871
  Payload ID: 10836
  Gene Symbol: NAT1
  Gene Name: N-acetyltransferase 1 (arylamine N-acetyltransferase)
  Uniprot ID: P18440
  ENSP ID: ENSP00000429407

SEQ ID NO: 54875 - protein, 290 aa, Homo sapiens; identical to SEQ ID NO: 54871
  Payload ID: 10836
  Gene Symbol: NAT1
  Gene Name: N-acetyltransferase 1 (arylamine N-acetyltransferase)
  Uniprot ID: P18440
  ENSP ID: ENSP00000440900

SEQ ID NO: 54876 - protein, 352 aa, Homo sapiens
  Payload ID: 10836
  Gene Symbol: NAT1
  Gene Name: N-acetyltransferase 1 (arylamine N-acetyltransferase)
  ENSP ID: ENSP00000443194
MLLLLLHKEAALEPQGPAVGYNSLPVSDDHHVSGIQARKKQQSVFWIKTEDQPTFNLLRKGIMDIEAYLERIGYKKSRNKLDLETLTDILQHQIRAVPFENLNIHCGDAMDLGLEAIFDQVVRRNRGGWCLQVNHLLYWALTTIGFETTMLGGYVYSTPAKKYSTGMIHLLLQVTIDGRNYIVDAGFGRSYQMWQPLELISGKDQPQVPCVFRLTEENGFWYLDQIRREQYIPNEEFLHSDLLEDSKYRKIYSFTLKPRTIEDFESMNTYLQTSPSSVFTSKSFCSLQTPDGVHCLVGFTLTHRRFNYKDNTDLIEFKTLSEEEIEKVLKNIFNISLQRKLVPKHGDRFFTI

SEQ ID NO: 54877 - protein, 1025 aa, Homo sapiens
  Payload ID: 10837
  Gene Symbol: NAT10
  Gene Name: N-acetyltransferase 10 (GCN5-related)
  Uniprot ID: Q9H0A0
  ENSP ID: ENSP00000257829
MHRKKVDNRIRILIENGVAERQRSLFVVVGDRGKDQVVILHHMLSKATVKARPSVLWCYKKELGFSSHRKKRMRQLQKKIKNGTLNIKQDDPFELFIAATNIRYCYYNETHKILGNTFGMCVLQDFEALTPNLLARTVETVEGGGLVVILLRTMNSLKQLYTVTMDVHSRYRTEAHQDVVGRFNERFILSLASCKKCLVIDDQLNILPISSHVATMEALPPQTPDESLGPSDLELRELKESLQDTQPVGVLVDCCKTLDQAKAVLKFIEGISEKTLRSTVALTAARGRGKSAALGLAIAGAVAFGYSNIFVTSPSPDNLHTLFEFVFKGFDALQYQEHLDYEIIQSLNPEFNKAVIRVNVFREHRQTIQYIHPADAVKLGQAELVVIDEAAAIPLPLVKSLLGPYLVFMASTINGYEGTGRSLSLKLIQQLRQQSAQSQVSTTAENKTTTTARLASARTLYEVSLQESIRYAPGDAVEKWLNDLLCLDCLNITRIVSGCPLPEACELYYVNRDTLFCYHKASEVFLQRLMALYVASHYKNSPNDLQMLSDAPAHHLFCLLPPVPPTQNALPEVLAVIQVCLEGEISRQSILNSLSRGKKASGDLIPWTVSEQFQDPDFGGLSGGRVVRIAVHPDYQGMGYGSRALQLLQMYYEGRFPCLEEKVLETPQEIHTVSSEAVSLLEEVITPRKDLPPLLLKLNERPAERLDYLGVSYGLTPRLLKFWKRAGFVPVYLRQTPNDLTGEHSCIMLKTLTDEDEADQGGWLAAFWKDFRRRFLALLSYQFSTFSPSLALNIIQNRNMGKPAQPALSREELEALFLPYDLKRLEMYSRNMVDYHLIMDMIPAISRIYFLNQLGDLALSAAQSALLLGIGLQHKSVDQLEKEIELPSGQLMGLFNRIIRKVVKLFNEVQEKAIEEQMVAAKDVVMEPTMKTLSDDLDEAAKEFQEKHKKEVGKLKSMDLSEYIIRGDDEEWNEVLNKAGPNASIISLKSDKKRKLEAKQEPKQSKKLKNRETKNKKDMKLKRKK

SEQ ID NO: 54878 - protein, 953 aa, Homo sapiens
  Payload ID: 10837
  Gene Symbol: NAT10
  Gene Name: N-acetyltransferase 10 (GCN5-related)
  Uniprot ID: Q9H0A0
  ENSP ID: ENSP00000433011
MRQLQKKIKNGTLNIKQDDPFELFIAATNIRYCYYNETHKILGNTFGMCVLQDFEALTPNLLARTVETVEGGGLVVILLRTMNSLKQLYTVTMDVHSRYRTEAHQDVVGRFNERFILSLASCKKCLVIDDQLNILPISSHVATMEALPPQTPDESLGPSDLELRELKESLQDTQPVGVLVDCCKTLDQAKAVLKFIEGISEKTLRSTVALTAARGRGKSAALGLAIAGAVAFGYSNIFVTSPSPDNLHTLFEFVFKGFDALQYQEHLDYEIIQSLNPEFNKAVIRVNVFREHRQTIQYIHPADAVKLGQAELVVIDEAAAIPLPLVKSLLGPYLVFMASTINGYEGTGRSLSLKLIQQLRQQSAQSQVSTTAENKTTTTARLASARTLYEVSLQESIRYAPGDAVEKWLNDLLCLDCLNITRIVSGCPLPEACELYYVNRDTLFCYHKASEVFLQRLMALYVASHYKNSPNDLQMLSDAPAHHLFCLLPPVPPTQNALPEVLAVIQVCLEGEISRQSILNSLSRGKKASGDLIPWTVSEQFQDPDFGGLSGGRVVRIAVHPDYQGMGYGSRALQLLQMYYEGRFPCLEEKVLETPQEIHTVSSEAVSLLEEVITPRKDLPPLLLKLNERPAERLDYLGVSYGLTPRLLKFWKRAGFVPVYLRQTPNDLTGEHSCIMLKTLTDEDEADQGGWLAAFWKDFRRRFLALLSYQFSTFSPSLALNIIQNRNMGKPAQPALSREELEALFLPYDLKRLEMYSRNMVDYHLIMDMIPAISRIYFLNQLGDLALSAAQSALLLGIGLQHKSVDQLEKEIELPSGQLMGLFNRIIRKVVKLFNEVQEKAIEEQMVAAKDVVMEPTMKTLSDDLDEAAKEFQEKHKKEVGKLKSMDLSEYIIRGDDEEWNEVLNKAGPNASIISLKSDKKRKLEAKQEPKQSKKLKNRETKNKKDMKLKRKK

SEQ ID NO: 54879 - protein, 145 aa, Homo sapiens
  Payload ID: 10837
  Gene Symbol: NAT10
  Gene Name: N-acetyltransferase 10 (GCN5-related)
  ENSP ID: ENSP00000435569
MHRKKVDNRIRILIENGVAERQRSLFVVVGDRGKDQVVILHHMLSKATVKARPSVLWCYKKELGFSSHRKKRMRQLQKKIKNGTLNIKQDDPFELFIAATNIRYCYYNETHKILGNTFGMCVLQDFEALTPNLLARTVETVEGGG

SEQ ID NO: 54880 - protein, 288 aa, Homo sapiens
  Payload ID: 10837
  Gene Symbol: NAT10
  Gene Name: N-acetyltransferase 10 (GCN5-related)
  ENSP ID: ENSP00000437324
MHRKKVDNRIRILIENGVAERQRSLFVVVGDRGKDQVVILHHMLSKATVKARPSVLWCYKKELGFSSHRKKRMRQLQKKIKNGTLNIKQDDPFELFIAATNIRYCYYNETHKILGNTFGMCVLQDFEALTPNLLARTVETVEGGGLVVILLRTMNSLKQLYTVTMDVHSRYRTEAHQDVVGRFNERFILSLASCKKCLVIDDQLNILPISSHVATMEALPPQTPDESLGPSDLELRELKESLQDTQPVGVLVDCCKTLDQAKQEPKQSKKLKNRETKNKKDMKLKRKK

SEQ ID NO: 54881 - protein, 834 aa, Homo sapiens
  Payload ID: 10837
  Gene Symbol: NAT10
  Gene Name: N-acetyltransferase 10 (GCN5-related)
  ENSP ID: ENSP00000479141
MNSLKQLYTVTMDVHSRYRTEAHQDVVGRFNERFILSLASCKKCLVIDDQLNILPISSHVATMEALPPQTPDESLGPSDLELRELKESLQDTQPVGVLVDCCKTLDQAKAVLKFIEGISEKTLRSTVALTAARGRGKSAALGLAIAGAVAFGYSNIFVTSPSPDNLHTLFEFVFKGFDALQYQEHLDYEIIQSLNPEFNKAVIRVNVFREHRQTIQYIHPADAVKLGQAELVVIDEAAAIPLPLVKSLLGPYLVFMASTINGYEGTGRSLSLKLIQQLRQQSAQSQVSTTAENKTTTTARLASARTLYEVSLQESIRYAPGDAVEKWLNDLLCLDCLNITRIVSGCPLPEACELYYVNRDTLFCYHKASEVFLQRLMALYVASHYKNSPNDLQMLSDAPAHHLFCLLPPVPPTQNALPEVLAVIQVCLEGEISRQSILNSLSRGKKASGDLIPWTVSEQFQDPDFGGLSGGRVVRIAVHPDYQGMGYGSRALQLLQMYYEGRFPCLEEKVLETPQEIHTVSSEAVSLLEEVITPRKDLPPLLLKLNERPAERLDYLGVSYGLTPRLLKFWKRAGFVPVYLRQTPNDLTGEHSCIMLKTLTDEDEADQGGWLAAFWKDFRRRFLALLSYQFSTFSPSLALNIIQNRNMGKPAQPALSREELEALFLPYDLKRLEMYSRNMVDYHLIMDMIPAISRIYFLNQLGDLALSAAQSALLLGIGLQHKSVDQLEKEIELPSGQLMGLFNRIIRKVVKLFNEVQEKAIEEQMVAAKDVVMEPTMKTLSDDLDEAAKEFQEKHKKEVGKLKSMDLSEYIIRGDDEEWNEVLNKAGRTPRSSA

SEQ ID NO: 54882 - protein, 206 aa, Homo sapiens
  Payload ID: 10838
  Gene Symbol: NAT14
  Gene Name: N-acetyltransferase 14 (GCN5-related, putative)
  Uniprot ID: Q8WUY8
  ENSP ID: ENSP00000205194
MAPSHLSVREMREDEKPLVLEMLKAGVKDTENRVALHALTRPPALLLLAAASSGLRFVLASFALALLLPVFLAVAAVKLGLRARWGSLPPPGGLGGPWVAVRGSGDVCGVLALAPGTNAGDGARVTRLSVSRWHRRRGVGRRLLAFAEARARAWAGGMGEPRARLVVPVAVAAWGVGGMLEGCGYQAEGGWGCLGYTLVREFSKDL

SEQ ID NO: 54883 - protein, 52 aa, Homo sapiens
  Payload ID: 10838
  Gene Symbol: NAT14
  Gene Name: N-acetyltransferase 14 (GCN5-related, putative)
  ENSP ID: ENSP00000470543
MAPSHLSVREMREDEKPLVLEMLKVRGRGPRGPGSGCSGGIASGFSHPLPPT

SEQ ID NO: 54884 - protein, 173 aa, Homo sapiens
  Payload ID: 10838
  Gene Symbol: NAT14
  Gene Name: N-acetyltransferase 14 (GCN5-related, putative)
  ENSP ID: ENSP00000471807
  MOD_RES (1)..(1): Any amino acid
XTENRVALHALTRPPALLLLAAASSGLRFVLASFALALLLPVFLAVAAVKLGLRARWGSLPPPGGLGGPWVAVRGSGDVCGVLALAPGTNAGDGARVTRLSVSRWHRRRGVGRRLLAFAEARARAWAGGMGEPRARLVVPVAVAAWGSVLSVPQAGRAIWGGGEEAEQNTPQS

SEQ ID NO: 54885 - protein, 44 aa, Homo sapiens
  Payload ID: 10838
  Gene Symbol: NAT14
  Gene Name: N-acetyltransferase 14 (GCN5-related, putative)
  ENSP ID: ENSP00000472383
MAPTPVCTEKPPRVMSAKSVLSVPQAGRAIWGGGEEAEQNTPQS

SEQ ID NO: 54886 - protein, 369 aa, Homo sapiens
  Payload ID: 10839
  Gene Symbol: NAT16
  Gene Name: N-acetyltransferase 16 (GCN5-related, putative)
  Uniprot ID: Q8N8M0
  ENSP ID: ENSP00000300303
MKLEASCGTATSEVPKPEKKTARDAEPSSETRPQEVEAEPRSGSGPEAEAEPLDFVVATEREFEEVLAISGGIYGGLDYLPSRYHSWLRDPDRTVVLAKRNGGVIALESVNVIDAGETVLVEGLRVAPWERGKGVAGLLQRFCSQLVKRQHPGVKVARLTRDDQLGPRELKKYRLITKQGILLVRFNASALLAGLGARLAALRTSGTFSPLPTEAVSEAGGDVARLLLSPSVQRDVLPGGTIIQDWQPYRPSESNLRLLAAKGLEWRVDSRARPRVLTLCTRPFPIPHGGDGTWRYLNIDAFGSDGAQVQSQLLWHLQRQAPRLVGLNVMCQLFLEPQLWSQLADFCQVGLGLELVKGYTEQYLLEADI

SEQ ID NO: 54887 - protein, 156 aa, Homo sapiens
  Payload ID: 10839
  Gene Symbol: NAT16
  Gene Name: N-acetyltransferase 16 (GCN5-related, putative)
  ENSP ID: ENSP00000391769
MKLEASCGTATSEVPKPEKKTARDAEPSSETRPQEVEAEPRSGSGPEAEAEPLDFVVATEREFEEVLAISGGIYGGLDYLPSRYHSWLRDPDRTVVLAKRNGGVIALESVNVIDAGETVLVEGLRVAPWERGKGVAGLLQRFCSQLVKRQHPGVKV

SEQ ID NO: 54888 - protein, 112 aa, Homo sapiens
  Payload ID: 10839
  Gene Symbol: NAT16
  Gene Name: N-acetyltransferase 16 (GCN5-related, putative)
  Uniprot ID: Q8N8M0
  ENSP ID: ENSP00000394435
MKLEASCGTATSEVPKPEKKTARDAEPSSETRPQEVEAEPRSGSGPEAEAEPLDFVVATEREFEEVLAISGGIYGGLDYLPSRYHSWLRDPDRTVVLAKRNGGVVSPGARPR

SEQ ID NO: 54889 - protein, 369 aa, Homo sapiens; identical to SEQ ID NO: 54886
  Payload ID: 10839
  Gene Symbol: NAT16
  Gene Name: N-acetyltransferase 16 (GCN5-related, putative)
  Uniprot ID: Q8N8M0
  ENSP ID: ENSP00000395125

SEQ ID NO: 54890 - protein, 290 aa, Homo sapiens
  Payload ID: 10840
  Gene Symbol: NAT2
  Gene Name: N-acetyltransferase 2 (arylamine N-acetyltransferase)
  Uniprot ID: P11245
  ENSP ID: ENSP00000286479
MDIEAYFERIGYKNSRNKLDLETLTDILEHQIRAVPFENLNMHCGQAMELGLEAIFDHIVRRNRGGWCLQVNQLLYWALTTIGFQTTMLGGYFYIPPVNKYSTGMVHLLLQVTIDGRNYIVDAGSGSSSQMWQPLELISGKDQPQVPCIFCLTEERGIWYLDQIRREQYITNKEFLNSHLLPKKKHQKIYLFTLEPRTIEDFESMNTYLQTSPTSSFITTSFCSLQTPEGVYCLVGFILTYRKFNYKDNTDLVEFKTLTEEEVEEVLRNIFKISLGRNLVPKPGDGSLTI

SEQ ID NO: 54891 - protein, 160 aa, Homo sapiens
  Payload ID: 10840
  Gene Symbol: NAT2
  Gene Name: N-acetyltransferase 2 (arylamine N-acetyltransferase)
  ENSP ID: ENSP00000428416
MWQPLELISGKDQPQVPCIFCLTEERGIWYLDQIRREQYITNKEFLNSHLLPKKKHQKIYLFTLEPRTIEDFESMNTYLQTSPTSSFITTSFCSLQTPEGVYCLVGFILTYRKFNYKDNTDLVEFKTLTEEEVEEVLRNIFKISLGRNLVPKPGDGSLTI

SEQ ID NO: 54892 - protein, 308 aa, Homo sapiens
  Payload ID: 10841
  Gene Symbol: NAT6
  Gene Name: N-acetyltransferase 6 (GCN5-related)
  Uniprot ID: Q93015
  ENSP ID: ENSP00000346927
MQELTLSPGPAKLTPTLDPTHRMELILSTSPAELTLDPACQPKLPLDSTCQPEMTFNPGPTELTLDPEHQPEETPAPSLAELTLEPVHRRPELLDACADLINDQWPRSRTSRLHSLGQSSDAFPLCLMLLSPHPTLEAAPVVVGHARLSRVLNQPQSLLVETVVVARALRGRGFGRRLMEGLEVFARARGFRKLHLTTHDQVHFYTHLGYQLGEPVQGLVFTSRRLPATLLNAFPTAPSPRPPRKAPNLTAQAAPRGPKGPPLPPPPPLPECLTISPPVPSGPPSKSLLETQYQNVRGRPIFWMEKDI

SEQ ID NO: 54893 - protein, 86 aa, Homo sapiens
  Payload ID: 10841
  Gene Symbol: NAT6
  Gene Name: N-acetyltransferase 6 (GCN5-related)
  ENSP ID: ENSP00000388316
MELILSTSPAELTLDPACQPKLPLDSTCQPEMTFNPGPTELTLDPEHQPEETPAPSLAELTLEPVHRRPELLDACADLINDQWPRS

SEQ ID NO: 54894 - protein, 57 aa, Homo sapiens
  Payload ID: 10841
  Gene Symbol: NAT6
  Gene Name: N-acetyltransferase 6 (GCN5-related)
  ENSP ID: ENSP00000391158
MELILSTSPAELTLDPACQPKLPLDSTCQPEMTFNPGPTELTLDPEHQPEETPAPSL

SEQ ID NO: 54895 - protein, 286 aa, Homo sapiens
  Payload ID: 10841
  Gene Symbol: NAT6
  Gene Name: N-acetyltransferase 6 (GCN5-related)
  Uniprot ID: Q93015
  ENSP ID: ENSP00000391893
MELILSTSPAELTLDPACQPKLPLDSTCQPEMTFNPGPTELTLDPEHQPEETPAPSLAELTLEPVHRRPELLDACADLINDQWPRSRTSRLHSLGQSSDAFPLCLMLLSPHPTLEAAPVVVGHARLSRVLNQPQSLLVETVVVARALRGRGFGRRLMEGLEVFARARGFRKLHLTTHDQVHFYTHLGYQLGEPVQGLVFTSRRLPATLLNAFPTAPSPRPPRKAPNLTAQAAPRGPKGPPLPPPPPLPECLTISPPVPSGPPSKSLLETQYQNVRGRPIFWMEKDI

SEQ ID NO: 54896 - protein, 286 aa, Homo sapiens; identical to SEQ ID NO: 54895
  Payload ID: 10841
  Gene Symbol: NAT6
  Gene Name: N-acetyltransferase 6 (GCN5-related)
  Uniprot ID: Q93015
  ENSP ID: ENSP00000400559

SEQ ID NO: 54897 - protein, 286 aa, Homo sapiens; identical to SEQ ID NO: 54895
  Payload ID: 10841
  Gene Symbol: NAT6
  Gene Name: N-acetyltransferase 6 (GCN5-related)
  Uniprot ID: Q93015
  ENSP ID: ENSP00000410610

SEQ ID NO: 54898 - protein, 9 aa, Homo sapiens
  Payload ID: 10841
  Gene Symbol: NAT6
  Gene Name: N-acetyltransferase 6 (GCN5-related)
  ENSP ID: ENSP00000413623
MELILSTSP

SEQ ID NO: 54899 - protein, 227 aa, Homo sapiens
  Payload ID: 10842
  Gene Symbol: NAT8
  Gene Name: N-acetyltransferase 8 (GCN5-related, putative)
  Uniprot ID: Q9UHE5
  ENSP ID: ENSP00000272425
MAPCHIRKYQESDRQWVVGLLSRGMAEHAPATFRQLLKLPRTLILLLGGPLALLLVSGSWLLALVFSISLFPALWFLAKKPWTEYVDMTLCTDMSDITKSYLSERGSCFWVAESEEKVVGMVGALPVDDPTLREKRLQLFHLFVDSEHRRQGIAKALVRTVLQFARDQGYSEVILDTGTIQLSAMALYQSMGFKKTGQSFFCVWARLVALHTVHFIYHLPSSKVGSL

SEQ ID NO: 54900 - protein, 224 aa, Homo sapiens
  Payload ID: 10843
  Gene Symbol: NAT8B
  Gene Name: N-acetyltransferase 8B (GCN5-related, putative, gene/pseudogene)
  ENSP ID: ENSP00000485054
MAPYHIRKYQESDRKVVGLLSRGMAEHAPATFRRLLKLPRTLILLLGGALALLLVSGSWILALVFSLSLLPALWFLAKKPWTRYVDIALRTDMSDITKSYLSECGSCFWVGESEEKVVGTVGALPVDDPTLREKRLQLFHLSVDNEHRGQGIAKALVRTVLQFARDGYSEVVLDTSNIQLSAMGLYQSLGFKKTGQSFFHVWARLVDLHTVHFIYHLPSAQAGR

SEQ ID NO: 54901 - protein, 134 aa, Homo sapiens
  Payload ID: 10844
  Gene Symbol: NAT8L
  Gene Name: N-acetyltransferase 8-like (GCN5-related, putative)
  ENSP ID: ENSP00000328464
MADIEQYYMKPPGSCFWVAVLDGNVVGIVAARAHEEDNTVELLRMSVDSRFRGKGIAKALGRKVLEFAVVHNYSAVVLGTTAVKVAAHKLYESLGFRHMGASDHYVLPGMTLSLAERLFFQVRYHRYRLQLREE

SEQ ID NO: 54902 - protein, 302 aa, Homo sapiens
  Payload ID: 10844
  Gene Symbol: NAT8L
  Gene Name: N-acetyltransferase 8-like (GCN5-related, putative)
  Uniprot ID: Q8N9F0
  ENSP ID: ENSP00000413064
MHCGPPDMVCETKIVAAEDHEALPGAKKDALLAAAGAMWPPLPAAPGPAAAPPAPPPAPVAQPHGGAGGAGPPGGRGVCIREFRAAEQEAARRIFYDGIMERIPNTAFRGLRQHPRAQLLYALLAALCFAVSRSLLLTCLVPAALLGLRYYYSRKVIRAYLECALHTDMADIEQYYMKPPGSCFWVAVLDGNVVGIVAARAHEEDNTVELLRMSVDSRFRGKGIAKALGRKVLEFAVVHNYSAVVLGTTAVKVAAHKLYESLGFRHMGASDHYVLPGMTLSLAERLFFQVRYHRYRLQLREE

SEQ ID NO: 54903 - protein, 207 aa, Homo sapiens
  Payload ID: 10845
  Gene Symbol: NAT9
  Gene Name: N-acetyltransferase 9 (GCN5-related, putative)
  Uniprot ID: Q9BTE0
  ENSP ID: ENSP00000350467
MRLNQNTLLLGKKVVLVPYTSEHVPSRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTVSESEHQWLLEQTSHVEEKPYRDGSAEPC

SEQ ID NO: 54904 - protein, 206 aa, Homo sapiens
  Payload ID: 10845
  Gene Symbol: NAT9
  Gene Name: N-acetyltransferase 9 (GCN5-related, putative)
  Uniprot ID: Q9BTE0
  ENSP ID: ENSP00000462019
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTVSESEHQWLLEQTSHVEEKPYRDGSAEPC

SEQ ID NO: 54905 - protein, 140 aa, Homo sapiens
  Payload ID: 10845
  Gene Symbol: NAT9
  Gene Name: N-acetyltransferase 9 (GCN5-related, putative)
  ENSP ID: ENSP00000462120
MRLNQNTLLLGKKVVLVPYTSEHVPSRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGGDPQTDSE

SEQ ID NO: 54906 - protein, 139 aa, Homo sapiens
  Payload ID: 10845
  Gene Symbol: NAT9
  Gene Name: N-acetyltransferase 9 (GCN5-related, putative)
  ENSP ID: ENSP00000462454
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGGDPQTDSE

SEQ ID NO: 54907 - protein, 212 aa, Homo sapiens
  Payload ID: 10845
  Gene Symbol: NAT9
  Gene Name: N-acetyltransferase 9 (GCN5-related, putative)
  ENSP ID: ENSP00000462835
MQAATMRLNQNTLLLGKKVVLVPYTSEHVPSRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTVSESEHQWLLEQTSHVEEKPYRDGSAEPC

SEQ ID NO: 54908 - protein, 135 aa, Homo sapiens
  Payload ID: 10845
  Gene Symbol: NAT9
  Gene Name: N-acetyltransferase 9 (GCN5-related, putative)
  ENSP ID: ENSP00000463353
MRLNQNTLLLGKKVVLVPYTSEHVPSRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYETSL

SEQ ID NO: 54909 - protein, 207 aa, Homo sapiens
  Payload ID: 10845
  Gene Symbol: NAT9
  Gene Name: N-acetyltransferase 9 (GCN5-related, putative)
  ENSP ID: ENSP00000463523
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAAWDRRVGAGASLLAPVSSPLRGVTTLGLTKFEAKIGQGNEPSIRMFQKLHFEQVATSSVFQEVTLRLTVSESEHQWLLEQTSHVEEKPYRDGSAEPC

SEQ ID NO: 54910 - protein, 82 aa, Homo sapiens
  Payload ID: 10845
  Gene Symbol: NAT9
  Gene Name: N-acetyltransferase 9 (GCN5-related, putative)
  ENSP ID: ENSP00000463760
MKSEELQRLTASEPLTLEQEYAMQCSWQEDADKCTFIVLDAEKWQAQPGATEESCMVGDVNLFLTDLEDLTLGEIEVMIAEP

SEQ ID NO: 54911 - protein, 202 aa, Homo sapiens
  Payload ID: 10845
  Gene Symbol: NAT9
  Gene Name: N-acetyltransferase 9 (GCN5-related, putative)
  ENSP ID: ENSP00000463824
MRLNQNTLLLGKKVVLVPYTSEHVPSRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGLTKFEAKIGQGNEPSIRMFQKLHFEQVATSSVFQEVTLRLTVSESEHQWLLEQTSHVEEKPYRDGSAEPC

SEQ ID NO: 54912 - protein, 109 aa, Homo sapiens
  Payload ID: 10845
  Gene Symbol: NAT9
  Gene Name: N-acetyltransferase 9 (GCN5-related, putative)
  ENSP ID: ENSP00000463860
MRLNQNTLLLGKKVVLVPYTSEHVPSRYHEWMKSEELQRLTASEPLTLEQEYAMQCSWQEDADKCTFIVLDAEKWQAQPGATEESCMVGDVNLFLTDLEDLTLGEIEVM

SEQ ID NO: 54913 - protein, 183 aa, Homo sapiens
  Payload ID: 10845
  Gene Symbol: NAT9
  Gene Name: N-acetyltransferase 9 (GCN5-related, putative)
  ENSP ID: ENSP00000464142
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTVSESEH

SEQ ID NO: 54914 - protein, 211 aa, Homo sapiens
  Payload ID: 10845
  Gene Symbol: NAT9
  Gene Name: N-acetyltransferase 9 (GCN5-related, putative)
  ENSP ID: ENSP00000464281
MQAATMRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTVSESEHQWLLEQTSHVEEKPYRDGSAEPC

SEQ ID NO: 54915 - protein, 56 aa, Homo sapiens
  Payload ID: 10845
  Gene Symbol: NAT9
  Gene Name: N-acetyltransferase 9 (GCN5-related, putative)
  ENSP ID: ENSP00000464505
MQAATMRLNQNTLLLGKKVVLVPYTSEHVPRYHEWMKSEELQRLTASEPLTLEQEY

SEQ ID NO: 54916 - protein, 156 aa, Homo sapiens
  Payload ID: 10845
  Gene Symbol: NAT9
  Gene Name: N-acetyltransferase 9 (GCN5-related, putative)
  ENSP ID: ENSP00000464681
MRLNQNTLLLGKKVVLVPYTSEHVPRYHEWMKSEELQRLTASEPLTLEQEYAMQCSWQEDADKCTFIVLDAEKWQAQPGATEESCMVGDVNLFLTDLEDLTLGEIEVMIAGGGPPVSAPSWSSVSPKWLLTIPMRQHTDSMRMVMIVATSELLRIK

SEQ ID NO: 54917 - protein, 113 aa, Homo sapiens
  Payload ID: 10846
  Gene Symbol: NATD1
  Gene Name: N-acetyltransferase domain containing 1
  Uniprot ID: Q8N6N6
  ENSP ID: ENSP00000478388
MAHSAAAVPLGALEQGCPIRVEHDRRRRQFTVRLNGCHDRAVLLYEYVGKRIVDLQHTEVPDAYRGRGIAKHLAKAALDFVVEEDLKAHLTCWYIQKYVKENPLPQYLERLQP
